United States Patent
Frejd et al.

(10) Patent No.: US 10,633,423 B2
(45) Date of Patent: Apr. 28, 2020

(54) IL-6-BINDING POLYPEPTIDE COMPLEX

(71) Applicants: AFFIBODY AB, Solna (SE); AbClon Inc., Seoul (KR)

(72) Inventors: Fredrik Frejd, Stockholm (SE); Lindvi Gudmundsdotter, Stockholm (SE)

(73) Assignees: AFFIBODY AB, Solna (SE); ABCLON, INC., Seoul (KR)

( * ) Notice: Subject to any disclaimer, the term of this patent is extended or adjusted under 35 U.S.C. 154(b) by 13 days.

(21) Appl. No.: 15/317,633

(22) PCT Filed: Jun. 15, 2015

(86) PCT No.: PCT/EP2015/063364
§ 371 (c)(1),
(2) Date: Dec. 9, 2016

(87) PCT Pub. No.: WO2015/189431
PCT Pub. Date: Dec. 17, 2015

(65) Prior Publication Data
US 2017/0129926 A1    May 11, 2017

(30) Foreign Application Priority Data

Jun. 13, 2014 (EP) .................................... 14172344

(51) Int. Cl.
| A61K 38/00 | (2006.01) |
| C07K 14/435 | (2006.01) |
| C07K 14/31 | (2006.01) |
| C07K 14/745 | (2006.01) |
| C07K 14/54 | (2006.01) |
| C07K 16/24 | (2006.01) |
| C07K 16/18 | (2006.01) |

(52) U.S. Cl.
CPC .......... C07K 14/31 (2013.01); C07K 14/5412 (2013.01); C07K 14/745 (2013.01); C07K 16/18 (2013.01); C07K 16/241 (2013.01); C07K 16/248 (2013.01); A61K 38/00 (2013.01); C07K 2317/21 (2013.01); C07K 2317/76 (2013.01); C07K 2317/92 (2013.01); C07K 2318/20 (2013.01); C07K 2319/00 (2013.01); C07K 2319/21 (2013.01); C07K 2319/31 (2013.01); C07K 2319/70 (2013.01)

(58) Field of Classification Search
CPC ............................... A61K 38/16; C07K 14/435
See application file for complete search history.

(56) References Cited

U.S. PATENT DOCUMENTS 6,830,894 B1    12/2004 Blaschuk
2009/0305962 A1    12/2009 Bakker et al.

FOREIGN PATENT DOCUMENTS

| WO | 9713781 | 4/1997 |
| WO | 2007009018 A2 | 1/2007 |
| WO | 2009077175 A1 | 6/2009 |
| WO | 2011110515 A1 | 9/2011 |
| WO | 2013030362 | 3/2013 |
| WO | 2013083813 A2 | 6/2013 |
| WO | 2013126006 A1 | 8/2013 |
| WO | 2014053586 | 4/2014 |
| WO | 2014064237 A1 | 5/2014 |
| WO | 2015189430 A1 | 12/2015 |

OTHER PUBLICATIONS

Dhillon, S., "Intravenous Tocilizumab: A Review of Its Use in Adults with Rheumatoid Arthritis", BioDrugs, vol. 28, No. 1, Feb. 2014, published online Nov. 20, 2013, pp. 75-106.
Grimm, S. et al., "Selection and characterisation of affibody molecules inhibiting the interaction between Ras and Raf in vitro", New Biotechnology, Elsevier BV, NL, vol. 27, No. 6, Dec. 31, 2010; pp. 766-771.
International Search Report for International Application No. PCT/EP2015/063364 filed on Jun. 15, 2015; dated Sep. 28, 2015; 6 pages.
Kobayashi, T. et al., "In Vitro Selection of a Peptide Inhibitor of Human IL-6 Using mRNA Display", Molecular Biotechnology, 2011, published online Dec. 7, 2010, vol. 48, No. 2, pp. 147-155.
Nygren, P., "Alternative binding proteins; Affibody binding proteins developed from a small three-helix bundle scaffold", FEBS Journal, Wiley Blackwell Publishing Ltd, GB vol. 275, No. 11, Jun. 1, 2008, pp. 2668-2676.
Wahlberg, E. et al., "An affibody in complex with a target protein: Structure and coupled folding", Proceedings of the National Academy of Sciences, Mar. 18, 2003, vol. 100, No. 6, pp. 3185-3190.
Written Opinion of the International Searching Authority for International Application No. PCT/EP2015/063364 filed on Jun. 15, 2015; dated Sep. 28, 2015; 8 pages.
Hennigan, Stephanie et al.,"Interleukin-6 inhibitors in the treatment of rheumatoid arthritis", Therapeutics and Clinical Risk Management 2008: 4(4); pp. 767-775.
Mechanism of Carcinogenesis, Section 3, 2008, International agency for research on cancer, 37 pages.
U.S. Non Final Office Action in U.S. Appl. No. 15/317,188, filed Dec. 8, 2016; dated Sep. 13, 2018; 17 pages.
"AA Amyloidosis", Amyloidosis Foundation http://amloidosis.org/facts/al/ downloaded Jan. 29, 2019; 3 pages.
Ataie-Kachoie, Parvin et al., "Inhibition of the IL-6 signaling pathway: A strategy to combat chronic inflammatory diseases and cancer" Cytokine & Growth Factor Reviews 24 (2013) 163-173.

(Continued)

Primary Examiner — Prema M Mertz
(74) Attorney, Agent, or Firm — Cantor Colburn LLP

(57) ABSTRACT

The present disclosure relates to complex comprising an engineered polypeptide having affinity for interleukin-6 (in the following referred to as IL-6) and an antibody or an antigen binding fragment thereof, wherein said engineered polypeptide having affinity for IL-6 belongs to a class of engineered polypeptides comprising the sequence $EEX_3X_4AWX_7EIHX_{11}$ LPN-$LX_{16}X_{17}X_{18}QX_{20}X_{21}AFIX_{25}X_{26}LX_{28}X_{29}$. The present disclosure also relates to the use of said complex as a therapeutic agent.

24 Claims, 62 Drawing Sheets
Specification includes a Sequence Listing.

(56) References Cited

OTHER PUBLICATIONS

Hagihara, K. et al., "IL-6 plays a critical role in the synergistic induction of human serum anmyloid A (SAA) gene when stimulated with proinflammatory cytokines as analyzed with an SAA iso form real-time quantitative RT-PCT assay system", BBRC, 314 (2004) 363-369.

Tanaka et al, Cold Spring Harb Perspect Biol 2014;6:a016295 (16 pages).

Yao, Xin et al., "Targeting interleukin-6 in inflammatory autoimmune diseases and cancers", Pharmacology & Thereapeutics 141 (2014) 125-139.

"Data from Phase 2 Study of Alder Biopharmaceuticals' Anti-IL-6 Antibody Therapeutic, ALD518, Demonstrate Reversal of Anemia in Patients with Advanced Non-Small Cell Lung Cancer", PR Newswire, Dec. 7, 2010, downloaded Feb. 6, 2019 from https://www.prnewswire.com/news-releases/data-from-phase-2-study-of-alder-biopharmaceuticals-anti-il-6-antibody-therapeutic-ald518-demonstrate-reversal-of-anemia-in-patients-with-advanced-non-small-cell-lung-cancer-111450629.html.

Coward, Jermaine et al., "Interleukin-6 as a therapeutic target in human ovarian cancer", Clin Cancer Res. Sep. 15, 2011; 17(18): 6083-6096.

Danese, Silvio, et al., "Randomised trial and open-label extension study of an anti-interleukin-6 antibody in Crohn's disease (ANDANTE I and II)", Gut, 2019;68:40-48, first published as 10.1136/gutjnl-2017-314562 online Dec. 15, 2017.

Mease, Philip J., "The Efficacy and Safety of Clazakizumab, an Anti-Interleukin-6 Monoclonal Antibody, in a Phase IIb Study of Adults With Active Psoriatic Arthritis", Arthritis & Rheumatology, vol. 68, No. 9, Sep. 2016, pp. 2163-2173.

Takeuchi, Tsutomu et al., Efficacy and safety of olokizumab in Asian patients with moderate-to-sever rheumatoid arthritis, previously exposed to anti-TNF therapy: Results from a randomized phase II trial; Modern Rheumatology, 26:1, 15-23, DOI:10.3109/14397595.2015.1074648.

Weinblatt, Michael E., "The Efficacy and Safety of Subcutaneous Clazakizumab in Patients With Moderate-to-Sever Rheumatoid Arthritis and an Inadequate Response to Methotrexate", Arthritis & Rheumatology, vol. 67, No. 10, Oct. 2015; pp. 2591-2600.

Gronwall Caroline, et al., "Selection and characterization of Affibody ligands binding to Alzheimer amyloid B peptides", Journal of Biotechnology 128 (2007) pp. 162-183.

"First-patient-dosing achieved in Mainland China Phase II Multi-regional clinical trial (MRCT)", I-Mab Biopharma, Oct. 12, 2018; https://www.prnewswire.com/news-releases/first-patient-dosing-achieved-in-mainland-ch . . . Nov. 14, 2019; 3 pages.

Cash, Hannes et al. "Interleukin 6 (IL-6) Deficiency Delays Lupus Nephritis in MRL—Faslpr Mice: The IL-6 Pathway as a New Therapeutic Target in Treatment of Autoimmune Kidney Disease in Systemic Lupus Erythematosus . . ." Journ Rheumatology 2019 vol. 37 No. 1; 12 pages.

Chao, K.C. et al., "Blockade of interleukin 6 accelerates acinar cell apoptosis and attneuates experimental acute pancreatitis in vivo", British Journal of Surgery 2006; 93; pp. 332-338.

ClinicalTrials.gov Identifier: NCT03235752: Ph. II Clinical trial Safety and Efficacy of TJ301 IV in Participants with Active Ulcerative Colitis, downloaded from the internet on Nov. 14, 2019.

Jayasekera, PL et al., "A case of tumour necrosis factor-x inhibitor- and rituximab-induced plantar pustular psoriasis that completely resolved with tocilizumab", British Journ of Dermatology (BJD) (2014) 171; pp. 1546-1549.

Jones, Gareth W. et al., "Loss of CD4+ T Cell IL-6R Expression during Inflammation Underlines a Role for IL-6 Trans Signaling in the Local Maintenance of Th17Cell", J Immunol published online Jan. 18, 2010, ol.0901528http://www.jimmunol.org/content/early/2010/01/18/jimmun; 11 pages.

Notice of Allowance U.S. Appl. No. 15/317,188, filed Dec. 6, 2016; dated Dec. 27, 2019; 9 pages.

Okiyama, N., et al., "Therapeutic Effects of Interleukin-6 Blockade in a Murine Model of Polymyositis That Does Not Require Interleukin-17A", Arthritis & Rheumatism, vol. 60, No. 8, Aug. 2009, pp. 2505-2512.

Serada, Satoshi et al., "IL-6 blockade inhibits the induction of myelin antigen-specific Th17 cells and Th1 cells in experimental autoimmune encephalomyelitis", PNAS, Jul. 2008, vol. 105., No. 26; pp. 9041-9046.

U.S. Final Office Action for U.S. Appl. No. 15/317,188, filed Dec. 8, 2016; dated Jun. 19, 2019; 33 pages.

Younis, Said, et al., "Tumor Necrosis Factor-associated Palmoplantar Pustular Psoriasis Treated with Interleukin 6 Blocker", J. Rheumatol 2012; 39; Downloaded from www.jrheum.org on Nov. 12, 2019; pp. 2055-2056.

Figure 1A

| Designation | Sequence | SEQ ID NO |
|---|---|---|
| Z14976 | VDAKYAKEERKAWYEIHLLPNLTVEQMAAFITKLFDDPSQSSELLSEAKKLNDSQAPK | 1 |
| Z15015 | VDAKYAKEERDAWWEIHALPNLTVEQMAAFITKLFDDPSQSSELLSEAKKLNDSQAPK | 2 |
| Z15122 | VDAKYAKEERHAWYEIHLLPNLTTIDQMAAFISKLFDDPSQSSELLSEAKKLNDSQAPK | 3 |
| Z14861 | VDAKYAKEERKAWIEIHNLPNLTIDQMAAFITKLFDDPSQSSELLSEAKKLNDSQAPK | 4 |
| Z14984 | VDAKYAKEEKQAWREIHLLPNLTTIDQMAAFITKLFDDPSQSSELLSEAKKLNDSQAPK | 5 |
| Z14630 | VDAKYAKEEKFAWWEIHKLPNLTVDQVAAFITKLFDDPSQSSELLSEAKKLNDSQAPK | 6 |
| Z11632 | VDAKYAKEEREAWFEIHTLPNLTVSQMAAFITKLFDDPSQSSELLSEAKKLNDSQAPK | 7 |
| Z14700 | VDAKYAKEERHAWFEIHKLPNLTVDQMAAFITKLFDDPSQSSELLSEAKKLNDSQAPK | 8 |
| Z14712 | VDAKYAKEEYLAWNEIHKLPNLTVDQMAAFITKLFDDPSQSSELLSEAKKLNDSQAPK | 9 |
| Z14862 | VDAKYAKEEAAAWREIHLLPNLTTIDQMAAFITKLFDDPSQSSELLSEAKKLNDSQAPK | 10 |
| Z15036 | VDAKYAKEEYEAWFEIHALPNLTVEQMAAFITKLFDDPSQSSELLSEAKKLNDSQAPK | 11 |
| Z15110 | VDAKYAKEERRAWTEIHSLPNLTIDQMAAFITKLFDDPSQSSELLSEAKKLNDSQAPK | 12 |
| Z15126 | VDAKYAKEERNAWYEIHLLPNLTIDQMAAFISKLFDDPSQSSELLSEAKKLNDSQAPK | 13 |
| Z15142 | VDAKYAKEERMAWYEIHSLPNLTVDQMAAFISKLFDDPSQSSELLSEAKKLNDSQAPK | 14 |
| Z11213 | VDAKYAKEEREAWYEIHVLPNLTVSQIAAFISKLFDDPSQSSELLSEAKKLNDSQAPK | 15 |
| Z11214 | VDAKYAKEERTAWFEIHTLPNLTVEQMAAFITKLFDDPSQSSELLSEAKKLNDSQAPK | 16 |
| Z11215 | VDAKYAKEEAEAWWEIHLLPNLTVSQMAAFITKLFDDPSQSSELLSEAKKLNDSQAPK | 17 |
| Z11217 | VDAKYAKEEREAWYEIHLLPNLTVEQIAAFITKLFDDPSQSSELLSEAKKLNDSQAPK | 18 |
| Z11222 | VDAKYAKEERDAWYEIHLLPNLTITQMAAFISKLFDDPSQSSELLSEAKKLNDSQAPK | 19 |
| Z11251 | VDAKYAKEEASAWFEIHTLPNLTVQQMAAFISKLFDDPSQSSELLSEAKKLNDSQAPK | 20 |
| Z11277 | VDAKYAKEEAKAWFEIHALPNLTVDQMAAFITKLFDDPSQSSELLSEAKKLNDSQAPK | 21 |
| Z11278 | VDAKYAKEERTANYEIHILPNLTVEQMAAFITKLFDDPSQSSELLSEAKKLNDSQAPK | 22 |
| Z11283 | VDAKYAKEEQQAWTEIHSLPNLTVDQMAAFITKLFDDPSQSSELLSEAKKLNDSQAPK | 23 |
| Z11300 | VDAKYAKEERDAWYEIHLLPNLTVEQIAAFISKLFDDPSQSSELLSEAKKLNDSQAPK | 24 |
| Z11321 | VDAKYAKEERVAWYEIHLLPNLTITQMAAFITKLFDDPSQSSELLSEAKKLNDSQAPK | 25 |
| Z11329 | VDAKYAKEERQAWYEIHLLPNLTVQQMAAFISKLFDDPSQSSELLSEAKKLNDSQAPK | 26 |
| Z11351 | VDAKYAKEEASAWFEIHTLPNLTVQQMAAFISKLFDDPSQSSELLSEAKKLNDSQAPK | 27 |
| Z11380 | VDAKYAKEEREAWYEIHVLPNLTVDQMAAFISKLFDDPSQSSELLSEAKKLNDSQAPK | 28 |
| Z11384 | VDAKYAKEERKAWYEIHLLPNLTVNQMAAFITKLFDDPSQSSELLSEAKKLNDSQAPK | 29 |
| Z11433 | VDAKYAKEERKAWYEIHLLPNLTVDQMAAFITKLFDDPSQSSELLSEAKKLNDSQAPK | 30 |
| Z11472 | VDAKYAKEEARAWHEIHLLPNLTVSQIAAFISKLFDDPSQSSELLSEAKKLNDSQAPK | 31 |
| Z11552 | VDAKYAKEERAAWYEIHLLPNLTVDQMAAFISKLFDDPSQSSELLSEAKKLNDSQAPK | 32 |
| Z11642 | VDAKYAKEERQAWYEIHTLPNLTAEQMAAFISKLFDDPSQSSELLSEAKKLNDSQAPK | 33 |

Figure 1B

| Designation | Sequence | SEQ ID NO |
|---|---|---|
| Z11644 | VDAKYAKEERQAWFEIHALPNLTVDQMAAFISKLFDDPSQSSELLSEAKKLNDSQAPK | 34 |
| Z11674 | VDAKYAKEEARAWREIHLLPNLTVQQMAAFISKLFDDPSQSSELLSEAKKLNDSQAPK | 35 |
| Z11698 | VDAKYAKEEAKAWREIHLLPNLTVTQMAAFISKLFDDPSQSSELLSEAKKLNDSQAPK | 36 |
| Z11711 | VDAKYAKEEAEAWREIHLLPNLTVNQMAAFISKLFDDPSQSSELLSEAKKLNDSQAPK | 37 |
| Z11723 | VDAKYAKEERDAWYEIHLLPNLTVQQMAAFISKLFDDPSQSSELLSEAKKLNDSQAPK | 38 |
| Z11781 | VDAKYAKEEREAWYEIHLLPNLTVRQMAAFISKLFDDPSQSSELLSEAKKLNDSQAPK | 39 |
| Z11784 | VDAKYAKEEREAWWEIHKLPNLTVNQMAAFISKLFDDPSQSSELLSEAKKLNDSQAPK | 40 |
| Z11788 | VDAKYAKEERRAWYEIHLLPNLTIQQMAAFISKLFDDPSQSSELLSEAKKLNDSQAPK | 41 |
| Z11789 | VDAKYAKEEAEAWREIHLLPNLTVHQMAAFISKLFDDPSQSSELLSEAKKLNDSQAPK | 42 |
| Z11791 | VDAKYAKEERDAWHEIHLLPNLTVSQMAAFISKLFDDPSQSSELLSEAKKLNDSQAPK | 43 |
| Z11794 | VDAKYAKEERRAWYEIHTLPNLTVQQMAAFISKLFDDPSQSSELLSEAKKLNDSQAPK | 44 |
| Z11802 | VDAKYAKEERKAWFEIHKLPNLTVEQMAAFISKLFDDPSQSSELLSEAKKLNDSQAPK | 45 |
| Z11803 | VDAKYAKEEHHAWTEIHLLPNLTVQQMAAFIQKLFDDPSQSSELLSEAKKLNDSQAPK | 46 |
| Z11805 | VDAKYAKEEARAWFEIHALPNLTVQQVAAFISKLFDDPSQSSELLSEAKKLNDSQAPK | 47 |
| Z11814 | VDAKYAKEEAKAWREIHILPNLTVQQMAAFIQKLFDDPSQSSELLSEAKKLNDSQAPK | 48 |
| Z11815 | VDAKYAKEEATAWHEIHTLPNLTVHQMAAFISKLFDDPSQSSELLSEAKKLNDSQAPK | 49 |
| Z11817 | VDAKYAKEERSAWYEIHLLPNLTVSQIAAFISKLFDDPSQSSELLSEAKKLNDSQAPK | 50 |
| Z11818 | VDAKYAKEERAAWFEIHTLPNLTVQQMAAFISKLFDDPSQSSELLSEAKKLNDSQAPK | 51 |
| Z11819 | VDAKYAKEERTAWYEIHLLPNLTVEQMAAFISKLFDDPSQSSELLSEAKKLNDSQAPK | 52 |
| Z11823 | VDAKYAKEERKAWFEIHALPNLTVSQMAAFISKLFDDPSQSSELLSEAKKLNDSQAPK | 53 |
| Z11824 | VDAKYAKEEHRAWFEIHLLPNLTVEQMAAFIQKLFDDPSQSSELLSEAKKLNDSQAPK | 54 |
| Z11833 | VDAKYAKEERAAWYEIHLLPNLTVQQMAAFISKLFDDPSQSSELLSEAKKLNDSQAPK | 55 |
| Z11835 | VDAKYAKEERQAWYEIHLLPNLTVSQIAAFISKLFDDPSQSSELLSEAKKLNDSQAPK | 56 |
| Z11836 | VDAKYAKEEAAAWREIHLLPNLTVQQMAAFISKLFDDPSQSSELLSEAKKLNDSQAPK | 57 |
| Z11860 | VDAKYAKEEREAWHEIHILPNLTVQQMAAFISKLFDDPSQSSELLSEAKKLNDSQAPK | 58 |
| Z11861 | VDAKYAKEEAQAWLEIHLLPNLTVDQIAAFISKLFDDPSQSSELLSEAKKLNDSQAPK | 59 |
| Z11862 | VDAKYAKEERKAWFEIHALPNLTVDQIAAFISKLFDDPSQSSELLSEAKKLNDSQAPK | 60 |
| Z11865 | VDAKYAKEERDAWYEIHLLPNLTVEQMAAFISKLFDDPSQSSELLSEAKKLNDSQAPK | 61 |
| Z11866 | VDAKYAKEEAAAWYEIHLLPNLTISQIAAFISKLFDDPSQSSELLSEAKKLNDSQAPK | 62 |
| Z11871 | VDAKYAKEERVAWYEIHLLPNLTVRQMAAFISKLFDDPSQSSELLSEAKKLNDSQAPK | 63 |
| Z11872 | VDAKYAKEEHHAWYEIHLLPNLTVSQIAAFISKLFDDPSQSSELLSEAKKLNDSQAPK | 64 |
| Z11874 | VDAKYAKEERAAWFEIHALPNLTVEQVAAFIIKLFDDPSQSSELLSEAKKLNDSQAPK | 65 |
| Z11875 | VDAKYAKEEQAWFEIHVLPNLTVTQMAAFISKLFDDPSQSSELLSEAKKLNDSQAPK | 66 |

Figure 1C

| Designation | Sequence | SEQ ID NO |
|---|---|---|
| Z11891 | VDAKYAKEEQQAWTEIHTLPNLTVDQMAAFISKLFDDPSQSSELLSEAKKLNDSQAPK | 67 |
| Z11882 | VDAKYAKEERDAWYEIHLLPNLTVTQMAAFISKLFDDPSQSSELLSEAKKLNDSQAPK | 68 |
| Z11883 | VDAKYAKEERDAWYEIHLLPNLTISQMAAFISKLFDDPSQSSELLSEAKKLNDSQAPK | 69 |
| Z11890 | VDAKYAKEEREAWHEIHILPNLTVEQIAAFISKLFDDPSQSSELLSEAKKLNDSQAPK | 70 |
| Z11892 | VDAKYAKEERDAWWEIHALPNLTVDQMAAFIQKLFDDPSQSSELLSEAKKLNDSQAPK | 71 |
| Z11893 | VDAKYAKEEARAWHEIHVLPNLTVSQMAAFIQKLFDDPSQSSELLSEAKKLNDSQAPK | 72 |
| Z11895 | VDAKYAKEEAQAWYEIHTLPNLTVEQMAAFIAKLFDDPSQSSELLSEAKKLNDSQAPK | 73 |
| Z11896 | VDAKYAKEERSAWWEIHTLPNLTVTQMAAFISKLFDDPSQSSELLSEAKKLNDSQAPK | 74 |
| Z11897 | VDAKYAKEEADAWWEIHALPNLTIDQMAAFISKLFDDPSQSSELLSEAKKLNDSQAPK | 75 |
| Z11901 | VDAKYAKEEAEAWYEIHLLPNLTVDQMAAFIIKLFDDPSQSSELLSEAKKLNDSQAPK | 76 |
| Z11903 | VDAKYAKEERAAWYEIHSLPNLTVDQMAAFISKLFDDPSQSSELLSEAKKLNDSQAPK | 77 |
| Z11904 | VDAKYAKEEQQAWLEIHLLPNLTIEQMAAFISKLFDDPSQSSELLSEAKKLNDSQAPK | 78 |
| Z11905 | VDAKYAKEERDAWYEIHLLPNLTVHQIAAFISKLFDDPSQSSELLSEAKKLNDSQAPK | 79 |
| Z11906 | VDAKYAKEERDAWYEIHTLPNLTVEQMAAFIWKLFDDPSQSSELLSEAKKLNDSQAPK | 80 |
| Z11907 | VDAKYAKEEQHAWLEIHKLPNLTVEQIAAFISKLFDDPSQSSELLSEAKKLNDSQAPK | 81 |
| Z11912 | VDAKYAKEEAAAWFEIHTLPNLTVDQMAAFISKLFDDPSQSSELLSEAKKLNDSQAPK | 82 |
| Z11918 | VDAKYAKEERDAWFEIHTLPNLTVTQMAAFIIKLFDDPSQSSELLSEAKKLNDSQAPK | 83 |
| Z11922 | VDAKYAKEERHAWHEIHILPNLTANQIAAFISKLFDDPSQSSELLSEAKKLNDSQAPK | 84 |
| Z11923 | VDAKYAKEEREAWFEIHLLPNLTFISQMAAFISKLFDDPSQSSELLSEAKKLNDSQAPK | 85 |
| Z11929 | VDAKYAKEEAEAWWEIHLLPNLTVQQIAAFISKLFDDPSQSSELLSEAKKLNDSQAPK | 86 |
| Z11933 | VDAKYAKEEAHAWYEIHILPNLTVSQMAAFISKLFDDPSQSSELLSEAKKLNDSQAPK | 87 |
| Z11937 | VDAKYAKEERAAWFEIHALPNLTIDQIAAFISKLFDDPSQSSELLSEAKKLNDSQAPK | 88 |
| Z11939 | VDAKYAKEEQRAWREIHLLPNLTIEQMSAFITKLFDDPSQSSELLSEAKKLNDSQAPK | 89 |
| Z14521 | VDAKYAKEEYDAWMEIHLLPNLTVDQMAAFITKLFDDPSQSSELLSEAKKLNDSQAPK | 90 |
| Z14524 | VDAKYAKEEKHAWREIHLLPNLTVEQMAAFITKLFDDPSQSSELLSEAKKLNDSQAPK | 91 |
| Z14525 | VDAKYAKEEKKAWTEIHLLPNLTIEQMAAFITKLFDDPSQSSELLSEAKKLNDSQAPK | 92 |
| Z14538 | VDAKYAKEERFAWTEIHLLPNLTVQQIAAFITKLFDDPSQSSELLSEAKKLNDSQAPK | 93 |
| Z14547 | VDAKYAKEERHAWTEIHLLPNLTIDQMAAFITKLFDDPSQSSELLSEAKKLNDSQAPK | 94 |
| Z14550 | VDAKYAKEERAAWFEIHALPNLTVEQVAAFITKLFDDPSQSSELLSEAKKLNDSQAPK | 95 |
| Z14551 | VDAKYAKEEKQAWYEIHNLPNLTVDQMAAFISKLFDDPSQSSELLSEAKKLNDSQAPK | 96 |
| Z14556 | VDAKYAKEEAQAWWEIHILPNLTVDQVAAFITKLFDDPSQSSELLSEAKKLNDSQAPK | 97 |
| Z14559 | VDAKYAKEEYEAWYEIHILPNLTVDQIAAFITKLFDDPSQSSELLSEAKKLNDSQAPK | 98 |
| Z14596 | VDAKYAKEEYEAWHEIHILPNLTVDQMAAFITKLFDDPSQSSELLSEAKKLNDSQAPK | 99 |

Figure 1D

| Designation | Sequence | SEQ ID NO |
|---|---|---|
| Z14609 | VDAKYAKEERMAWMEIHLLPNLTVEQMAAFISKLFDDPSQSSELLSEAKKLNDSQAPK | 100 |
| Z14614 | VDAKYAKEEYDAWVEIHALPNLTVEQVAAFITKLFDDPSQSSELLSEAKKLNDSQAPK | 101 |
| Z14620 | VDAKYAKEEYEAWVEIHKLPNLTIDQMAAFITKLFDDPSQSSELLSEAKKLNDSQAPK | 102 |
| Z14634 | VDAKYAKEEYHAWYEIHLLPNLTIDQMAAFITKLFDDPSQSSELLSEAKKLNDSQAPK | 103 |
| Z14645 | VDAKYAKEEKDAWYEIHLLPNLTVEQIAAFITKLFDDPSQSSELLSEAKKLNDSQAPK | 104 |
| Z14651 | VDAKYAKEEKHAWHEIHILPNLTVEQMAAFITKLFDDPSQSSELLSEAKKLNDSQAPK | 105 |
| Z14662 | VDAKYAKEERKAAWFEIHALPNLTVEQVAAFITKLFDDPSQSSELLSEAKKLNDSQAPK | 106 |
| Z14673 | VDAKYAKEEYHAWMEIHLLPNLTVSQMAAFITKLFDDPSQSSELLSEAKKLNDSQAPK | 107 |
| Z14706 | VDAKYAKEEAFAWKEIHLLPNLTIDQMAAFITKLFDDPSQSSELLSEAKKLNDSQAPK | 108 |
| Z14710 | VDAKYAKEEYEAWYEIHLLPNLTVSQIAAFITKLFDDPSQSSELLSEAKKLNDSQAPK | 109 |
| Z14720 | VDAKYAKEEYYAWWEIHKLPNLTVDQMAAFITKLFDDPSQSSELLSEAKKLNDSQAPK | 110 |
| Z14722 | VDAKYAKEEAVAWKEIHILPNLTVSQMAAFITKLFDDPSQSSELLSEAKKLNDSQAPK | 111 |
| Z14731 | VDAKYAKEEKAAWYEIHLLPNLTIEQMAAFITKLFDDPSQSSELLSEAKKLNDSQAPK | 112 |
| Z14746 | VDAKYAKEERAAWTEIHLLPNLTVEQMAAFITKLFDDPSQSSELLSEAKKLNDSQAPK | 113 |
| Z14765 | VDAKYAKEERMAWYEIHTLPNLTVPNLTVDQIAAFITKLFDDPSQSSELLSEAKKLNDSQAPK | 114 |
| Z14767 | VDAKYAKEEHHAWREIHLLPNLTIQQMAAFITKLFDDPSQSSELLSEAKKLNDSQAPK | 115 |
| Z14782 | VDAKYAKEEAKAWMEIHLLPNLTIDQMAAFITKLFDDPSQSSELLSEAKKLNDSQAPK | 116 |
| Z14783 | VDAKYAKEEKAAWYEIHLLPNLTVDQIAAFITKLFDDPSQSSELLSEAKKLNDSQAPK | 117 |
| Z14784 | VDAKYAKEEKHAWMEIHKLPNLTVDQMAAFITKLFDDPSQSSELLSEAKKLNDSQAPK | 118 |
| Z14788 | VDAKYAKEEKAAWNEIHKLPNLTVSQMAAFITKLFDDPSQSSELLSEAKKLNDSQAPK | 119 |
| Z14829 | VDAKYAKEERKAWVEIHNLPNLTVDQMAAFITKLFDDPSQSSELLSEAKKLNDSQAPK | 120 |
| Z14867 | VDAKYAKEEAIAWHEIHVLPNLTVDQIAAFITKLFDDPSQSSELLSEAKKLNDSQAPK | 121 |
| Z14868 | VDAKYAKEEYEAWYEIHLLPNLTIQQMAAFITKLFDDPSQSSELLSEAKKLNDSQAPK | 122 |
| Z14878 | VDAKYAKEEYHAWVEIHNLPNLTIDQMAAFITKLFDDPSQSSELLSEAKKLNDSQAPK | 123 |
| Z14888 | VDAKYAKEEAFAWREIHLLPNLTIDQMAAFITKLFDDPSQSSELLSEAKKLNDSQAPK | 124 |
| Z14929 | VDAKYAKEEKEAWYEIHLLPNLTVSQMAAFITKLFDDPSQSSELLSEAKKLNDSQAPK | 125 |
| Z14944 | VDAKYAKEERKAWYEIHLLPNLTIDQMAAFITKLFDDPSQSSELLSEAKKLNDSQAPK | 126 |
| Z14990 | VDAKYAKEEYDAWYEIHTLPNLTVDQMAAFITKLFDDPSQSSELLSEAKKLNDSQAPK | 127 |
| Z14992 | VDAKYAKEERNAWTEIHLLPNLTIEQMAAFITKLFDDPSQSSELLSEAKKLNDSQAPK | 128 |
| Z15003 | VDAKYAKEEYKAWLEIHNLPNLTVDQMAAFITKLFDDPSQSSELLSEAKKLNDSQAPK | 129 |
| Z15024 | VDAKYAKEEYEAWMEIHLLPNLTVEQIAAFITKLFDDPSQSSELLSEAKKLNDSQAPK | 130 |
| Z15025 | VDAKYAKEERDAWFEIHKLPNLTVDQMAAFITKLFDDPSQSSELLSEAKKLNDSQAPK | 131 |
| Z15031 | VDAKYAKEEYAWKEIHLLPNLTVDQMAAFITKLFDDPSQSSELLSEAKKLNDSQAPK | 132 |

Figure 1E

| Designation | Sequence | SEQ ID NO |
|---|---|---|
| Z15042 | VDAKYAKEEYFAWWEIHKLPNLTVNQMAAFITKLFDDPSQSSELLSEAKKLNDSQAPK | 133 |
| Z15053 | VDAKYAKEEKQAWVEIHNLPNLTITQMAAFITKLFDDPSQSSELLSEAKKLNDSQAPK | 134 |
| Z15057 | VDAKYAKEEQRAWYEIHILPNLTTDQMAAFITKLFDDPSQSSELLSEAKKLNDSQAPK | 135 |
| Z15067 | VDAKYAKEEARAWREIHALPNLTIDQMAAFITKLFDDPSQSSELLSEAKKLNDSQAPK | 136 |
| Z15079 | VDAKYAKEERYAWNEIHILPNLTVDQMAAFITKLFDDPSQSSELLSEAKKLNDSQAPK | 137 |
| Z15082 | VDAKYAKEEAKAWYEIHILPNLTVDQIAAFITKLFDDPSQSSELLSEAKKLNDSQAPK | 138 |
| Z15097 | VDAKYAKEEARAWHEIHILPNLTIDQMAAFITKLFDDPSQSSELLSEAKKLNDSQAPK | 139 |
| Z15102 | VDAKYAKEEKKAWYEIHLLPNLTIEQMAAFITKLFDDPSQSSELLSEAKKLNDSQAPK | 140 |
| Z15111 | VDAKYAKEEARAWTEIHLLPNLTVDQMAAFITKLFDDPSQSSELLSEAKKLNDSQAPK | 141 |
| Z15117 | VDAKYAKEERSAWMEIHLLPNLTVDQMAAFITKLFDDPSQSSELLSEAKKLNDSQAPK | 142 |
| Z15129 | VDAKYAKEEREAWFEIHILPNLTIDQMAAFITKLFDDPSQSSELLSEAKKLNDSQAPK | 143 |
| Z15140 | VDAKYAKEEYEAWTEIHLLPNLTIEQMAAFITKLFDDPSQSSELLSEAKKLNDSQAPK | 144 |
| Z15141 | VDAKYAKEEYEAWVEIHNLPNLTITQMAAFITKLFDDPSQSSELLSEAKKLNDSQAPK | 145 |
| Z15145 | VDAKYAKEEYKAWHEIHILPNLTVDQIAAFITKLFDDPSQSSELLSEAKKLNDSQAPK | 146 |
| Z15151 | VDAKYAKEEREAWMEIHLLPNLTIDQMAAFITKLFDDPSQSSELLSEAKKLNDSQAPK | 147 |
| Z15159 | VDAKYAKEEYKAWVEIHLLPNLTVDQIAAFITKLFDDPSQSSELLSEAKKLNDSQAPK | 148 |
| Z15162 | VDAKYAKEEKIAWYEIHLLPNLTVNQIAAFITKLFDDPSQSSELLSEAKKLNDSQAPK | 149 |
| Z15164 | VDAKYAKEEAYAWKEIHALPNLTVTQMAAFITKLFDDPSQSSELLSEAKKLNDSQAPK | 150 |
| Z11612 | VDAKYAKEEQVAWWEISHLPNLTITQVVAFIQKLFDDPSQSSELLSEAKKLNDSQAPK | 151 |
| Z11616 | VDAKYAKEEQVAWWEISHLPNLTIEQVVAFIQKLFDDPSQSSELLSEAKKLNDSQAPK | 152 |
| Z11133 | VDAKYAKEEREAWYEIHTLPNLTAQQMAAFIVKLYDDPSQSSELLSEAKKLNDSQAPK | 153 |
| Z11134 | VDAKYAKEEAQAWLEIHLLPNLTVDQMAAFISKLFDDPSQSSELLSEAKKLNDSQAPK | 154 |
| Z11135 | VDAKYAKEERHAWFEIHSLPNLTVNQMSAFITKLFDDPSQSSELLSEAKKLNDSQAPK | 155 |
| Z11136 | VDAKYAKEEADAWWEIHALPNLTVDQMAAFISKLFDDPSQSSELLSEAKKLNDSQAPK | 156 |
| Z11137 | VDAKYAKEEARAWLEIHALPNLTVTQMAAFIIKLYDDPSQSSELLSEAKKLNDSQAPK | 157 |
| Z11138 | VDAKYAKEERRAWTEIHLLPNLTVDQMAAFISKLFDDPSQSSELLSEAKKLNDSQAPK | 158 |
| Z11139 | VDAKYAKEERHAWYEIHTLPNLTVTQMSAFIQKLFDDPSQSSELLSEAKKLNDSQAPK | 159 |
| Z11140 | VDAKYAKEEAQAWFEIHLLPNLTIDQMAAFISKLFDDPSQSSELLSEAKKLNDSQAPK | 160 |
| Z11141 | VDAKYAKEERAAWHEIHVLPNLTVSQMAAFIIKLFDDPSQSSELLSEAKKLNDSQAPK | 161 |
| Z11142 | VDAKYAKEERHAWFEIHVLPNLTVHQRAAFISKLFDDPSQSSELLSEAKKLNDSQAPK | 162 |
| Z11143 | VDAKYAKEEREAWYEIHTLPNLTINQRTAFIQKLFDDPSQSSELLSEAKKLNDSQAPK | 163 |
| Z11144 | VDAKYAKEERHAWFEIHTLPNLTVSQMAAFIMKLFDDPSQSSELLSEAKKLNDSQAPK | 164 |
| Z11145 | VDAKYAKEERHAWYEIHVLPNLTVSQMAAFITKLFDDPSQSSELLSEAKKLNDSQAPK | 165 |

Figure 1F

| Designation | Sequence | SEQ ID NO |
|---|---|---|
| Z11146 | VDAKYAKEERDAWLEIHMLPNLTITQVAAFISKLFDDPSQSSELLSEAKKLNDSQAPK | 166 |
| Z11147 | VDAKYAKEEARAWHEIHVLPNLTAEQMAAFISKLFDDPSQSSELLSEAKKLNDSQAPK | 167 |
| Z11148 | VDAKYAKEEAEAWLEIHLLPNLTVEQITAFISKLFDDPSQSSELLSEAKKLNDSQAPK | 168 |
| Z11149 | VDAKYAKEERDAWHEIHLLPNLTVEQRAAFISKLFDDPSQSSELLSEAKKLNDSQAPK | 169 |
| Z11150 | VDAKYAKEERKAWTEIHSLPNLTVTQMAAFISKLFDDPSQSSELLSEAKKLNDSQAPK | 170 |
| Z11151 | VDAKYAKEERDAWHEIHILPNLTVEQMSAFISKLFDDPSQSSELLSEAKKLNDSQAPK | 171 |
| Z11152 | VDAKYAKEEAEAWFEIHALPNLTAEQMAAFISKLFDDPSQSSELLSEAKKLNDSQAPK | 172 |
| Z11153 | VDAKYAKEEHQAWWEIHLLPNLTVDQMSAFISKLFDDPSQSSELLSEAKKLNDSQAPK | 173 |
| Z11154 | VDAKYAKEERDAWHEIHKLPNLTVNQVAAFISKLFDDPSQSSELLSEAKKLNDSQAPK | 174 |
| Z11155 | VDAKYAKEEADAWFEIHLLPNLTVDQIAAFIQKLFDDPSQSSELLSEAKKLNDSQAPK | 175 |
| Z11156 | VDAKYAKEERAAWYEIHVLPNLTVEQMAAFIQKLFDDPSQSSELLSEAKKLNDSQAPK | 176 |
| Z11157 | VDAKYAKEEHRAWHEIHLLPNLTVNQIAAFISKLFDDPSQSSELLSEAKKLNDSQAPK | 177 |
| Z11158 | VDAKYAKEEAVAWHEIHMLPNLTVEQMAAFISKLFDDPSQSSELLSEAKKLNDSQAPK | 178 |
| Z11159 | VDAKYAKEEREAWWEIHALPNLTVSQMAAFISKLFDDPSQSSELLSEAKKLNDSQAPK | 179 |
| Z11160 | VDAKYAKEERKAWFEIHSLPNLTVDQMSAFISKLFDDPSQSSELLSEAKKLNDSQAPK | 180 |
| Z11161 | VDAKYAKEEQRAWWEIHTLPNLTTDQMAAFISKLFDDPSQSSELLSEAKKLNDSQAPK | 181 |
| Z11162 | VDAKYAKEERQAWFEIHALPNLTVDQAAAFIIKLYDDPSQSSELLSEAKKLNDSQAPK | 182 |
| Z11163 | VDAKYAKEEARAWTEIHALPNLTVDQMAAFIIKLYDDPSQSSELLSEAKKLNDSQAPK | 183 |
| Z11164 | VDAKYAKEERRAWHEIHMLPNLTVTQMSAFISKLFDDPSQSSELLSEAKKLNDSQAPK | 184 |
| Z11165 | VDAKYAKEEAKAWLEIHKLPNLTVNQMAAFISKLFDDPSQSSELLSEAKKLNDSQAPK | 185 |
| Z11166 | VDAKYAKEEREAWHEIHLLPNLTISQIAAFISKLFDDPSQSSELLSEAKKLNDSQAPK | 186 |
| Z11167 | VDAKYAKEEQHAWYEIHLLPNLTVTQMAAFISKLFDDPSQSSELLSEAKKLNDSQAPK | 187 |
| Z11168 | VDAKYAKEEHKAWFEIHLLPNLTISQMAAFISKLFDDPSQSSELLSEAKKLNDSQAPK | 188 |
| Z11169 | VDAKYAKEERRAWYEIHLLPNLTVTQMTAFISKLFDDPSQSSELLSEAKKLNDSQAPK | 189 |
| Z11170 | VDAKYAKEERHAWTEIHILPNLTVRQMAAFISKLFDDPSQSSELLSEAKKLNDSQAPK | 190 |
| Z11171 | VDAKYAKEERHAWHEIHLLPNLTIQQMAAFISKLFDDPSQSSELLSEAKKLNDSQAPK | 191 |
| Z11172 | VDAKYAKEEQHAWTEIHLLPNLTIQQMAAFIQKLFDDPSQSSELLSEAKKLNDSQAPK | 192 |
| Z11173 | VDAKYAKEEHRAWTEIHLLPNLTVSQMVAFISKLFDDPSQSSELLSEAKKLNDSQAPK | 193 |
| Z11174 | VDAKYAKEEQDAWYEIHVLPNLTVEQLVAFISKLFDDPSQSSELLSEAKKLNDSQAPK | 194 |
| Z11175 | VDAKYAKEEREAWHEIHSLPNLTVDQMTAFIIKLMDDPSQSSELLSEAKKLNDSQAPK | 195 |
| Z11176 | VDAKYAKEEAAAWFEIHLLPNLTTEQMAAFIMKLFDDPSQSSELLSEAKKLNDSQAPK | 196 |
| Z11177 | VDAKYAKEERAAWYEIHILPNLTVRQMAAFISKLFDDPSQSSELLSEAKKLNDSQAPK | 197 |
| Z11178 | VDAKYAKEEARAWTEIHALPNLTVDQVTAFIIKLYDDPSQSSELLSEAKKLNDSQAPK | 198 |

Figure 1G

| Designation | Sequence | SEQ ID NO |
|---|---|---|
| Z11179 | VDAKYAKEEQRAWFEIHTLPNLTVDQIEAFISKLFDDPSQSSELLSEAKKLNDSQAPK | 199 |
| Z11180 | VDAKYAKEEAAAWHEIHILPNLTVSQMAAFISKLFDDPSQSSELLSEAKKLNDSQAPK | 200 |
| Z11181 | VDAKYAKEEAQAWHEIHSLPNLTVEQTSAFIQKLFDDPSQSSELLSEAKKLNDSQAPK | 201 |
| Z11182 | VDAKYAKEEREAWHEIHALPNLTIDQRVAFISKLFDDPSQSSELLSEAKKLNDSQAPK | 202 |
| Z11183 | VDAKYAKEEREAWYEIHLLPNLTINQMAAFISKLFDDPSQSSELLSEAKKLNDSQAPK | 203 |
| Z11184 | VDAKYAKEEERDAWYEIHLLPNLTIRQMAAFISKLFDDPSQSSELLSEAKKLNDSQAPK | 204 |
| Z11185 | VDAKYAKEEQKAWTEIHLLPNLTVHQIAAFISKLFDDPSQSSELLSEAKKLNDSQAPK | 205 |
| Z11186 | VDAKYAKEERAAWREIHLLPNLTTEQRTAFISKLFDDPSQSSELLSEAKKLNDSQAPK | 206 |
| Z11187 | VDAKYAKEEQDAWREIHLLPNLTINQIVAFIQKLFDDPSQSSELLSEAKKLNDSQAPK | 207 |
| Z11188 | VDAKYAKEEREAWYEIHSLPNLTVTQIAAFISKLFDDPSQSSELLSEAKKLNDSQAPK | 208 |
| Z11189 | VDAKYAKEEATAWYEIHILPNLTVDQMAAFISKLFDDPSQSSELLSEAKKLNDSQAPK | 209 |
| Z11190 | VDAKYAKEERDAWYEIHKLPNLTANQMAAFISKLFDDPSQSSELLSEAKKLNDSQAPK | 210 |
| Z11191 | VDAKYAKEERDAWFEIHALPNLTVHQMTAFIIKLFDDPSQSSELLSEAKKLNDSQAPK | 211 |
| Z11192 | VDAKYAKEEREAWSEIHKLPNLTVDQMAAFISKLFDDPSQSSELLSEAKKLNDSQAPK | 212 |
| Z11193 | VDAKYAKEEREAWFEIHLLPNLTVDQMAAFISKLFDDPSQSSELLSEAKKLNDSQAPK | 213 |
| Z11194 | VDAKYAKEERKAWYEIHLLPNLTVQQMAAFISKLFDDPSQSSELLSEAKKLNDSQAPK | 214 |
| Z11195 | VDAKYAKEEREAWYEIHSLPNLTVNQVAAFISKLFDDPSQSSELLSEAKKLNDSQAPK | 215 |
| Z11196 | VDAKYAKEERHAWREIHLLPNLTTEQRVAFIIKLFDDPSQSSELLSEAKKLNDSQAPK | 216 |
| Z11197 | VDAKYAKEEREAWTEIHSLPNLTVDQVTAFISKLFDDPSQSSELLSEAKKLNDSQAPK | 217 |
| Z11198 | VDAKYAKEERDAWWEIHLLPNLTVNQISAFISKLFDDPSQSSELLSEAKKLNDSQAPK | 218 |
| Z11199 | VDAKYAKEEHHAWREIHLLPNLTVEQMAAFISKLFDDPSQSSELLSEAKKLNDSQAPK | 219 |
| Z11200 | VDAKYAKEEQQAWHEIHLLPNLTVDQMAAFISKLFDDPSQSSELLSEAKKLNDSQAPK | 220 |
| Z11201 | VDAKYAKEEAQAWHEIHILPNLTIHQMSAFISKLFDDPSQSSELLSEAKKLNDSQAPK | 221 |
| Z11202 | VDAKYAKEEAKAWHEIHVLPNLTIDQIAAFISKLFDDPSQSSELLSEAKKLNDSQAPK | 222 |
| Z11203 | VDAKYAKEEAQAWHEIHTLPNLTTEQMAAFISKLFDDPSQSSELLSEAKKLNDSQAPK | 223 |
| Z11204 | VDAKYAKEERDAWSEIHSLPNLTFISQMAAFISKLFDDPSQSSELLSEAKKLNDSQAPK | 224 |
| Z11205 | VDAKYAKEERKAWHEIHILPNLTAEQLAAFISKLFDDPSQSSELLSEAKKLNDSQAPK | 225 |
| Z11206 | VDAKYAKEEADAWREIHVLPNLTTQQITAFIQKLFDDPSQSSELLSEAKKLNDSQAPK | 226 |
| Z11207 | VDAKYAKEERSAWTEIHMLPNLTVQQRAAFISKLFDDPSQSSELLSEAKKLNDSQAPK | 227 |
| Z11208 | VDAKYAKEEREAWYEIHLLPNLTIDQMSAFIQKLFDDPSQSSELLSEAKKLNDSQAPK | 228 |
| Z11209 | VDAKYAKEEREAWYEIHLLPNLTVEQIVAFISKLFDDPSQSSELLSEAKKLNDSQAPK | 229 |
| Z11210 | VDAKYAKEERKAWFEIHSLPNLTVNQMAAFIQKLFDDPSQSSELLSEAKKLNDSQAPK | 230 |
| Z11211 | VDAKYAKEEADAWFEIHLLPNLTIDQVSAFISKLFDDPSQSSELLSEAKKLNDSQAPK | 231 |

Figure 1H

| Designation | Sequence | SEQ ID NO |
|---|---|---|
| Z11212 | VDAKYAKEERDAWFEIHLLPNLTIEQMAAFISKLFDDPSQSSELLSEAKKLNDSQAPK | 232 |
| Z11216 | VDAKYAKEEADAWREIHTLPNLTVDQMSAFISKLFDDPSQSSELLSEAKKLNDSQAPK | 233 |
| Z11219 | VDAKYAKEERVAWYEIHMLPNLTTNQMAAFISKLFDDPSQSSELLSEAKKLNDSQAPK | 234 |
| Z11220 | VDAKYAKEERDAWYEIHLLPNLTVNQMAAFISKLFDDPSQSSELLSEAKKLNDSQAPK | 235 |
| Z11221 | VDAKYAKEERDAWWEIHSLPNLTTQQMAAFIIKLFDDPSQSSELLSEAKKLNDSQAPK | 236 |
| Z11223 | VDAKYAKEEARAWHEIHTLPNLTIEQMAAFISKLFDDPSQSSELLSEAKKLNDSQAPK | 237 |
| Z11225 | VDAKYAKEERAAWYEIHLLPNLTVEQTAAFISKLFDDPSQSSELLSEAKKLNDSQAPK | 238 |
| Z11226 | VDAKYAKEEREAWYEIHLLPNLTVEQIAAFISKLFDDPSQSSELLSEAKKLNDSQAPK | 239 |
| Z11227 | VDAKYAKEEQHAWREIHLLPNLTTDQMAAFIQKLFDDPSQSSELLSEAKKLNDSQAPK | 240 |
| Z11228 | VDAKYAKEEASAWWEIHLLPNLTTTQRAAFISKLFDDPSQSSELLSEAKKLNDSQAPK | 241 |
| Z11230 | VDAKYAKEEATAWYEIHALPNLTVDQMVAFISKLFDDPSQSSELLSEAKKLNDSQAPK | 242 |
| Z11231 | VDAKYAKEEHKAWTEIHLLPNLTVSQISAFISKLFDDPSQSSELLSEAKKLNDSQAPK | 243 |
| Z11232 | VDAKYAKEEQAAWREIHTLPNLTIEQIAAFISKLFDDPSQSSELLSEAKKLNDSQAPK | 244 |
| Z11233 | VDAKYAKEERAAWFEIHTLPNLTVNQMAAFISKLFDDPSQSSELLSEAKKLNDSQAPK | 245 |
| Z11234 | VDAKYAKEEAAAWFEIHALPNLTVNQMAAFISKLFDDPSQSSELLSEAKKLNDSQAPK | 246 |
| Z11236 | VDAKYAKEEAKAWFEIHKLPNLTAEQISAFIIKLFDDPSQSSELLSEAKKLNDSQAPK | 247 |
| Z11238 | VDAKYAKEEREAWYEIHLLPNLTVQQIVAFIVAFISKLFDDPSQSSELLSEAKKLNDSQAPK | 248 |
| Z11239 | VDAKYAKEEQQAWYEIHLLPNLTIEQMAAFIQKLFDDPSQSSELLSEAKKLNDSQAPK | 249 |
| Z11240 | VDAKYAKEERDAWFEIHSLPNLTVDQMVAFISKLFDDPSQSSELLSEAKKLNDSQAPK | 250 |
| Z11241 | VDAKYAKEEAEAWFEIHALPNLETHLLPNLTVQQMAAFISKLFDDPSQSSELLSEAKKLNDSQAPK | 251 |
| Z11242 | VDAKYAKEEQKAWHEIHTLPNLTVDQTTAFISKLFDDPSQSSELLSEAKKLNDSQAPK | 252 |
| Z11243 | VDAKYAKEEREAWYEIHLLPNLTIEQMVAFISKLFDDPSQSSELLSEAKKLNDSQAPK | 253 |
| Z11244 | VDAKYAKEEAEAWFEIHTLPNLTVDQMAAFIVKLYDDPSQSSELLSEAKKLNDSQAPK | 254 |
| Z11245 | VDAKYAKEEAEAWFEIHTLPNLTVTQIAAFISKLFDDPSQSSELLSEAKKLNDSQAPK | 255 |
| Z11246 | VDAKYAKEERQAWYEIHALPNLTADQMAAFIQKLFDDPSQSSELLSEAKKLNDSQAPK | 256 |
| Z11247 | VDAKYAKEEQSANYEIHALPNLETHLLPNLTVQQMEAFISKLFDDPSQSSELLSEAKKLNDSQAPK | 257 |
| Z11248 | VDAKYAKEEADAWLETHLLPNLTVEQMAAFISKLFDDPSQSSELLSEAKKLNDSQAPK | 258 |
| Z11249 | VDAKYAKEEQQAWWEIHTLPNLTVDQRSAFIVKLYDDPSQSSELLSEAKKLNDSQAPK | 259 |
| Z11250 | VDAKYAKEERKAWHEIHILPNLTVNQISAFIQKLFDDPSQSSELLSEAKKLNDSQAPK | 260 |
| Z11252 | VDAKYAKEEAHAWWEIHKLPNLTTDQTAAFISKLFDDPSQSSELLSEAKKLNDSQAPK | 261 |
| Z11253 | VDAKYAKEERDAWYEIHILPNLTVTQMAAFISKLFDDPSQSSELLSEAKKLNDSQAPK | 262 |
| Z11254 | VDAKYAKEEAQAWREIHTLPNLTAQQMAAFISKLFDDPSQSSELLSEAKKLNDSQAPK | 263 |
| Z11255 | VDAKYAKEERRAWHEIHVLPNLTVEQMAAFISKLFDDPSQSSELLSEAKKLNDSQAPK | 264 |

Figure 1I

| Designation | Sequence | SEQ ID NO |
|---|---|---|
| Z11256 | VDAKYAKEEREAMSEIHLLPNLTVTQMAAFISKLFDDPSQSSELLSEAKKLNDSQAPK | 265 |
| Z11257 | VDAKYAKEERKAWYEIHLLPNLTVSQMAAFIHLLPNLTVSQMAAFISKLFDDPSQSSELLSEAKKLNDSQAPK | 266 |
| Z11258 | VDAKYAKEEARAWYEIHLLPNLTVTQMAAFISKLFDDPSQSSELLSEAKKLNDSQAPK | 267 |
| Z11259 | VDAKYAKEEHEAWTEIHKLPNLTTEQMAAFISKLFDDPSQSSELLSEAKKLNDSQAPK | 268 |
| Z11260 | VDAKYAKEERDAWFEIHSLPNLTVQQMAAFISKLFDDPSQSSELLSEAKKLNDSQAPK | 269 |
| Z11261 | VDAKYAKEEQSAWHEIHLLPNLTVDQIAAFISKLFDDPSQSSELLSEAKKLNDSQAPK | 270 |
| Z11262 | VDAKYAKEEQAAWYEIHALPNLTVDQMTAFISKLFDDPSQSSELLSEAKKLNDSQAPK | 271 |
| Z11263 | VDAKYAKEEAAAWREIHLLPNLTTQQMAAFISKLFDDPSQSSELLSEAKKLNDSQAPK | 272 |
| Z11264 | VDAKYAKEEREAWYEIHILPNLTVEQMAAFISKLFDDPSQSSELLSEAKKLNDSQAPK | 273 |
| Z11265 | VDAKYAKEERKAWYEIHILPNLTVDQMAAFISKLFDDPSQSSELLSEAKKLNDSQAPK | 274 |
| Z11266 | VDAKYAKEEAKAWREIHLLPNLTVEQMAAFISKLFDDPSQSSELLSEAKKLNDSQAPK | 275 |
| Z11267 | VDAKYAKEEAQAWSEIHMLPNLTVTQIAAFISKLFDDPSQSSELLSEAKKLNDSQAPK | 276 |
| Z11268 | VDAKYAKEEAHAWHEIHILPNLTVDQMSAFISKLFDDPSQSSELLSEAKKLNDSQAPK | 277 |
| Z11269 | VDAKYAKEEREAWFEIHLLPNLTVEQIAAFISKLFDDPSQSSELLSEAKKLNDSQAPK | 278 |
| Z11270 | VDAKYAKEERKAWWEIHLLPNLTIEQMAAFISKLFDDPSQSSELLSEAKKLNDSQAPK | 279 |
| Z11271 | VDAKYAKEERDAWYEIHTLPNLTVEQMVAFISKLFDDPSQSSELLSEAKKLNDSQAPK | 280 |
| Z11272 | VDAKYAKEERKAWYEIHALPNLTVSQMAAFIIKLYDDPSQSSELLSEAKKLNDSQAPK | 281 |
| Z11273 | VDAKYAKEEHKAWWEIHALPNLTISQITAFISKLFDDPSQSSELLSEAKKLNDSQAPK | 282 |
| Z11274 | VDAKYAKEEAQAWYEIHLLPNLTIEQMAAFISKLFDDPSQSSELLSEAKKLNDSQAPK | 283 |
| Z11275 | VDAKYAKEEQDAWWEIHALPNLTIDQMAAFISKLFDDPSQSSELLSEAKKLNDSQAPK | 284 |
| Z11276 | VDAKYAKEEHDAWWEIHILPNLTVEQIAAFISKLFDDPSQSSELLSEAKKLNDSQAPK | 285 |
| Z11279 | VDAKYAKEEARAWLEIHTLPNLFTTQRAAFISKLFDDPSQSSELLSEAKKLNDSQAPK | 286 |
| Z11281 | VDAKYAKEERKAWHEIHILPNLTINQRAAFISKLFDDPSQSSELLSEAKKLNDSQAPK | 287 |
| Z11282 | VDAKYAKEEREAWYEIHMLPNLTVTQMAAFISKLFDDPSQSSELLSEAKKLNDSQAPK | 288 |
| Z11284 | VDAKYAKEERDAWFEIHILPNLTHQMAAFISKLFDDPSQSSELLSEAKKLNDSQAPK | 289 |
| Z11285 | VDAKYAKEEHDAWYEIHTLPNLTVDQMVAFISKLFDDPSQSSELLSEAKKLNDSQAPK | 290 |
| Z11286 | VDAKYAKEEAQAWYEIHTLPNLTLPNLTVDQMAAFISKLFDDPSQSSELLSEAKKLNDSQAPK | 291 |
| Z11287 | VDAKYAKEERVAWWEIHSLPNLTIDQRSAFISKLFDDPSQSSELLSEAKKLNDSQAPK | 292 |
| Z11288 | VDAKYAKEEHEAWTEIHLLPNLTVSQIAAFISKLFDDPSQSSELLSEAKKLNDSQAPK | 293 |
| Z11289 | VDAKYAKEEAQAWREIHLLPNLTVDQIAAFISKLFDDPSQSSELLSEAKKLNDSQAPK | 294 |
| Z11290 | VDAKYAKEERDAWHEIHVLPNLTAEQMSAFISKLFDDPSQSSELLSEAKKLNDSQAPK | 295 |
| Z11291 | VDAKYAKEEATAWFEIHTLPNLTVDQMAAFIIKLFDDPSQSSELLSEAKKLNDSQAPK | 296 |
| Z11293 | VDAKYAKEERHAWFEIHTLPNLTVTQMAAFISKLFDDPSQSSELLSEAKKLNDSQAPK | 297 |

Figure 1J

| Designation | Sequence | SEQ ID NO |
|---|---|---|
| Z11294 | VDAKYAKEEREAWWEIHALPNLTTNQVAAFISKLFDDPSQSSELLSEAKKLNDSQAPK | 298 |
| Z11295 | VDAKYAKEERRAWWEIHLLPNLTIQQIAAFISKLFDDPSQSSELLSEAKKLNDSQAPK | 299 |
| Z11296 | VDAKYAKEEAHAWFEIHILPNLTTDQMAAFISKLFDDPSQSSELLSEAKKLNDSQAPK | 300 |
| Z11297 | VDAKYAKEEARAWREIHLLPNLTVEQMAAFISKLFDDPSQSSELLSEAKKLNDSQAPK | 301 |
| Z11298 | VDAKYAKEERRAWYEIHTLPNLTVEQLSAFISKLFDDPSQSSELLSEAKKLNDSQAPK | 302 |
| Z11299 | VDAKYAKEEAHAWHEIHVLPNLTVEQIAAFISKLFDDPSQSSELLSEAKKLNDSQAPK | 303 |
| Z11301 | VDAKYAKEEREAWFEIHTLPNLTVEQMAAFISKLFDDPSQSSELLSEAKKLNDSQAPK | 304 |
| Z11302 | VDAKYAKEERDAWWEIHSLPNLTIDQMAAFISKLFDDPSQSSELLSEAKKLNDSQAPK | 305 |
| Z11303 | VDAKYAKEEARAWHEIHILPNLTIQQITAFIQKLFDDPSQSSELLSEAKKLNDSQAPK | 306 |
| Z11304 | VDAKYAKEEQKAWHEIHLLPNLTINQIVAFISKLFDDPSQSSELLSEAKKLNDSQAPK | 307 |
| Z11305 | VDAKYAKEEREAWYEIHILPNLTVNQVAAFISKLFDDPSQSSELLSEAKKLNDSQAPK | 308 |
| Z11306 | VDAKYAKEERVAWYEIHALPNLTVTQMAAFISKLFDDPSQSSELLSEAKKLNDSQAPK | 309 |
| Z11307 | VDAKYAKEERVAWLEIHALPNLTVDQMAAFIIKLFDDPSQSSELLSEAKKLNDSQAPK | 310 |
| Z11308 | VDAKYAKEERDAWFEIHMLPNLTVNQMAAFIIKLFDDPSQSSELLSEAKKLNDSQAPK | 311 |
| Z11309 | VDAKYAKEEAVAWFEIHTLPNLTVEQMAAFIVKLFDDPSQSSELLSEAKKLNDSQAPK | 312 |
| Z11310 | VDAKYAKEEQDAWSEIHLLPNLTVNQMAAFISKLFDDPSQSSELLSEAKKLNDSQAPK | 313 |
| Z11311 | VDAKYAKEERDAWWEIHALPNLTVDQMVAFISKLFDDPSQSSELLSEAKKLNDSQAPK | 314 |
| Z11312 | VDAKYAKEEAHAWHEIHVLPNLTVDQIHAFISKLFDDPSQSSELLSEAKKLNDSQAPK | 315 |
| Z11313 | VDAKYAKEERRAWYEIHLLPNLTAEQMAAFISKLFDDPSQSSELLSEAKKLNDSQAPK | 316 |
| Z11314 | VDAKYAKEEAWAWFEIHTLPNLTVTQMAAFISKLFDDPSQSSELLSEAKKLNDSQAPK | 317 |
| Z11315 | VDAKYAKEEQEAWYEIHILPNLTISQMAAFISKLFDDPSQSSELLSEAKKLNDSQAPK | 318 |
| Z11316 | VDAKYAKEERDAWYEIHTLPNLTVTQMAAFISKLFDDPSQSSELLSEAKKLNDSQAPK | 319 |
| Z11317 | VDAKYAKEERQAWTEIHLLPNLTVVQMAAFISKLFDDPSQSSELLSEAKKLNDSQAPK | 320 |
| Z11318 | VDAKYAKEERDAWLEIHTLPNLTVEQMAAFISKLFDDPSQSSELLSEAKKLNDSQAPK | 321 |
| Z11319 | VDAKYAKEEQRAWTEIHTLPNLTVDQITAFISKLFDDPSQSSELLSEAKKLNDSQAPK | 322 |
| Z11320 | VDAKYAKEERKAWWEIHLLPNLTVDQIAAFISKLFDDPSQSSELLSEAKKLNDSQAPK | 323 |
| Z11322 | VDAKYAKEEARAWHEIHILPNLTVTQMAAFISKLFDDPSQSSELLSEAKKLNDSQAPK | 324 |
| Z11323 | VDAKYAKEREAWHEIHKLPNLTTHQVAAFIWKLFDDPSQSSELLSEAKKLNDSQAPK | 325 |
| Z11324 | VDAKYAKEEQDAWWEIHALPNLTTEEQMAAFISKLFDDPSQSSELLSEAKKLNDSQAPK | 326 |
| Z11325 | VDAKYAKEEAAAWFEIHTLPNLTIEQMSAFIEQMAAFISKLFDDPSQSSELLSEAKKLNDSQAPK | 327 |
| Z11326 | VDAKYAKEEREAWFEIHLLPNLTIEQMAAFISKLFDDPSQSSELLSEAKKLNDSQAPK | 328 |
| Z11327 | VDAKYAKEERKAWYEIHTLPNLTVNQMAAFISKLFDDPSQSSELLSEAKKLNDSQAPK | 329 |
| Z11328 | VDAKYAKEERQAWLEIHTLPNLTIEQMAAFISKLFDDPSQSSELLSEAKKLNDSQAPK | 330 |

Figure 1K

| Designation | Sequence | SEQ ID NO |
|---|---|---|
| Z11330 | VDAKYAKEEHHAWLEIHTLPNLTVDQMAAFISKLFDDPSQSSELLSEAKKLNDSQAPK | 331 |
| Z11331 | VDAKYAKEEQAWWEIHKLPNLTVEQMTAFIIKLYDDPSQSSELLSEAKKLNDSQAPK | 332 |
| Z11332 | VDAKYAKEERKAWFEIHALPNLTVTQVAAFISKLFDDPSQSSELLSEAKKLNDSQAPK | 333 |
| Z11333 | VDAKYAKEEHRAWTEIHKLPNLTTQQMAAFISKLFDDPSQSSELLSEAKKLNDSQAPK | 334 |
| Z11334 | VDAKYAKEEAQAWHEIHILPNLTVDQMAAFISKLFDDPSQSSELLSEAKKLNDSQAPK | 335 |
| Z11335 | VDAKYAKEEQKAWFEIHLLPNLTVEQIAAFIQKLFDDPSQSSELLSEAKKLNDSQAPK | 336 |
| Z11336 | VDAKYAKEERHAWYEIHLLPNLTVRQMAAFISKLFDDPSQSSELLSEAKKLNDSQAPK | 337 |
| Z11337 | VDAKYAKEERDAWYEIHLLPNLTVNQIAAFISKLFDDPSQSSELLSEAKKLNDSQAPK | 338 |
| Z11338 | VDAKYAKEEAHAWWEIHALPNLTVDQMAAFISKLFDDPSQSSELLSEAKKLNDSQAPK | 339 |
| Z11339 | VDAKYAKEEADAWFEIHVLPNLTIQQIAAFISKLFDDPSQSSELLSEAKKLNDSQAPK | 340 |
| Z11340 | VDAKYAKEERRAWFEIHILPNLTINQMAAFISKLFDDPSQSSELLSEAKKLNDSQAPK | 341 |
| Z11341 | VDAKYAKEERKAWYEIHVLPNLTVRQMAAFIQKLFDDPSQSSELLSEAKKLNDSQAPK | 342 |
| Z11342 | VDAKYAKEERHAWHEIHILPNLTVDQISAFISKLFDDPSQSSELLSEAKKLNDSQAPK | 343 |
| Z11343 | VDAKYAKEERKAWLEIHLLPNLTVEQMAAFISKLFDDPSQSSELLSEAKKLNDSQAPK | 344 |
| Z11344 | VDAKYAKEEREAWWEIHKLPNLTVTQMAAFISKLFDDPSQSSELLSEAKKLNDSQAPK | 345 |
| Z11345 | VDAKYAKEERHAWYEIHTLPNLTVNQMAAFISKLFDDPSQSSELLSEAKKLNDSQAPK | 346 |
| Z11346 | VDAKYAKEERHAWYEIHVLPNLTVQQMAAFIQKLFDDPSQSSELLSEAKKLNDSQAPK | 347 |
| Z11347 | VDAKYAKEEAAAWREIHSLPNLTVEQIAAFIQKLFDDPSQSSELLSEAKKLNDSQAPK | 348 |
| Z11348 | VDAKYAKEEAAAWHEIHILPNLTVQQITAFISKLFDDPSQSSELLSEAKKLNDSQAPK | 349 |
| Z11349 | VDAKYAKEEHQAWTEIHLLPNLTVSQIAAFIMKLFDDPSQSSELLSEAKKLNDSQAPK | 350 |
| Z11350 | VDAKYAKEERKAWYETHSLPNLTVSQIAAFIQKLFDDPSQSSELLSEAKKLNDSQAPK | 351 |
| Z11352 | VDAKYAKEEASAWTEIHLLPNLTIDQMAAFISKLFDDPSQSSELLSEAKKLNDSQAPK | 352 |
| Z11353 | VDAKYAKEEQSAWYEIHILPNLTVDQIAAFISKLFDDPSQSSELLSEAKKLNDSQAPK | 353 |
| Z11354 | VDAKYAKEEADAWYEIHLLPNLTVNQMAAFISKLFDDPSQSSELLSEAKKLNDSQAPK | 354 |
| Z11355 | VDAKYAKEEQRAWFEIHTLPNLTVSQMAAFISKLFDDPSQSSELLSEAKKLNDSQAPK | 355 |
| Z11356 | VDAKYAKEEAHAWYEIHLLPNLTVSQIAAFISKLFDDPSQSSELLSEAKKLNDSQAPK | 356 |
| Z11357 | VDAKYAKEEHQAWREIHLLPNLHVLPNLTVPNLTVQQIAAFISKLFDDPSQSSELLSEAKKLNDSQAPK | 357 |
| Z11358 | VDAKYAKEERKAWYEIHSLPNLTVSQMAAFISKLFDDPSQSSELLSEAKKLNDSQAPK | 358 |
| Z11359 | VDAKYAKEEAHAWREIHVLPNLTVDQMAAFISKLFDDPSQSSELLSEAKKLNDSQAPK | 359 |
| Z11360 | VDAKYAKEEAKAWTEIHLLPNLTVHQIAAFISKLFDDPSQSSELLSEAKKLNDSQAPK | 360 |
| Z11361 | VDAKYAKEEREAWFEIHKLPNLTVNQMAAFIIKLFDDPSQSSELLSEAKKLNDSQAPK | 361 |
| Z11362 | VDAKYAKEEARAWYEIHILPNLTVTQMAAFITKLFDDPSQSSELLSEAKKLNDSQAPK | 362 |
| Z11363 | VDAKYAKEEREAWFEIHLLPNLTITQMAAFISKLFDDPSQSSELLSEAKKLNDSQAPK | 363 |

Figure 1L

| Designation | Sequence | SEQ ID NO |
|---|---|---|
| Z11364 | VDAKYAKEERDAWYEIHLLPNLTVTQMSAFISKLFDDPSQSSELLSEAKKLNDSQAPK | 364 |
| Z11365 | VDAKYAKEEHEAWLEIHALPNLTVEQMSAFIIKLYDDPSQSSELLSEAKKLNDSQAPK | 365 |
| Z11366 | VDAKYAKEEREAWFEIHLLPNLTVHQMAAFISKLFDDPSQSSELLSEAKKLNDSQAPK | 366 |
| Z11367 | VDAKYAKEEHQAWTEIHLLPNLTTEQMAAFIQKLFDDPSQSSELLSEAKKLNDSQAPK | 367 |
| Z11368 | VDAKYAKEEARAWYEIHVLPNLTTDQRSAFISKLFDDPSQSSELLSEAKKLNDSQAPK | 368 |
| Z11369 | VDAKYAKEERDAWFEIHTLPNLTVSQMAAFISKLFDDPSQSSELLSEAKKLNDSQAPK | 369 |
| Z11370 | VDAKYAKEERQAWFEIHSLPNLTVTQMAAFISKLFDDPSQSSELLSEAKKLNDSQAPK | 370 |
| Z11371 | VDAKYAKEERQAWWEIHALPNLTAEQVAAFISKLFDDPSQSSELLSEAKKLNDSQAPK | 371 |
| Z11372 | VDAKYAKEEAKAWYEIHTLPNLTVDQISAFIIKLFDDPSQSSELLSEAKKLNDSQAPK | 372 |
| Z11373 | VDAKYAKEEREAWWEIHLLPNLTVDQISAFISKLFDDPSQSSELLSEAKKLNDSQAPK | 373 |
| Z11374 | VDAKYAKEEADAWTEIHSLPNLTVEQMAAFIWKLLDDPSQSSELLSEAKKLNDSQAPK | 374 |
| Z11375 | VDAKYAKEERAAWWEIHTLPNLTTDQRSAFIIKLYDDPSQSSELLSEAKKLNDSQAPK | 375 |
| Z11376 | VDAKYAKEEHRAWTEIHLLPNLTTDQMAAFISKLFDDPSQSSELLSEAKKLNDSQAPK | 376 |
| Z11377 | VDAKYAKEEADAWWEIHMLPNLTTEQRSAFISKLFDDPSQSSELLSEAKKLNDSQAPK | 377 |
| Z11378 | VDAKYAKEEREAWWEIHKLPNLTVEQVAAFISKLFDDPSQSSELLSEAKKLNDSQAPK | 378 |
| Z11379 | VDAKYAKEEAHAWWEIHALPNLTVHQMAAFISKLFDDPSQSSELLSEAKKLNDSQAPK | 379 |
| Z11381 | VDAKYAKEEAQAWREIHVLPNLTVQQIAAFISKLFDDPSQSSELLSEAKKLNDSQAPK | 380 |
| Z11382 | VDAKYAKEERHAWWEIHILPNLTVEQQVAAFISKLFDDPSQSSELLSEAKKLNDSQAPK | 381 |
| Z11383 | VDAKYAKEEAQAWWEIHTLPNLTVEQLAAFISKLFDDPSQSSELLSEAKKLNDSQAPK | 382 |
| Z11385 | VDAKYAKEEHRAWYEIHTLPNLTTDQVAAFISKLFDDPSQSSELLSEAKKLNDSQAPK | 383 |
| Z11386 | VDAKYAKEEREAWHEIHLLPNLTIEQVAAFISKLFDDPSQSSELLSEAKKLNDSQAPK | 384 |
| Z11387 | VDAKYAKEEQKAWWEIHLLPNLTTEQMAAFISKLFDDPSQSSELLSEAKKLNDSQAPK | 385 |
| Z11388 | VDAKYAKEEQAAWLEIHLLPNLTVEQMAAFISKLFDDPSQSSELLSEAKKLNDSQAPK | 386 |
| Z11389 | VDAKYAKEEREAWWEIHALPNLTTNQMAAFISKLFDDPSQSSELLSEAKKLNDSQAPK | 387 |
| Z11390 | VDAKYAKEEAEAWYEIHILPNLTITQMAAFISKLFDDPSQSSELLSEAKKLNDSQAPK | 388 |
| Z11391 | VDAKYAKEERQAWYEIHLLPNLTIEQMAAFIIKLFDDPSQSSELLSEAKKLNDSQAPK | 389 |
| Z11392 | VDAKYAKEEAKAWFEIHLLPNLTVTQMAAFISKLFDDPSQSSELLSEAKKLNDSQAPK | 390 |
| Z11393 | VDAKYAKEEADAWWEIHSLPNLTVDQTAAFISKLFDDPSQSSELLSEAKKLNDSQAPK | 391 |
| Z11394 | VDAKYAKEERVAWYEIHILPNLTVEQTAAFIIKLFDDPSQSSELLSEAKKLNDSQAPK | 392 |
| Z11395 | VDAKYAKEERKAWYEIHTLPNLTVDQMSAFIIKLYDDPSQSSELLSEAKKLNDSQAPK | 393 |
| Z11396 | VDAKYAKEEAQAWFEIHTLPNLTIEQMAAFISKLFDDPSQSSELLSEAKKLNDSQAPK | 394 |
| Z11397 | VDAKYAKEERQAWYEIHALPNLTVDQMAAFISKLFDDPSQSSELLSEAKKLNDSQAPK | 395 |
| Z11398 | VDAKYAKEEADAWFEIHVLPNLTTEQMTAFISKLFDDPSQSSELLSEAKKLNDSQAPK | 396 |

Figure 1M

| Designation | Sequence | SEQ ID NO |
|---|---|---|
| Z11399 | VDAKYAKEERRAWFEIHALPNLTVEQMAAFISKLFDDPSQSSELLSEAKKLNDSQAPK | 397 |
| Z11400 | VDAKYAKEEAKAWYEIHSLPNLTVNQMAAFISKLFDDPSQSSELLSEAKKLNDSQAPK | 398 |
| Z11401 | VDAKYAKEEARAWHEIHTLPNLTVHQMAAFIQKLFDDPSQSSELLSEAKKLNDSQAPK | 399 |
| Z11402 | VDAKYAKEERRAWREIHTLPNLTVSQMAAFISKLFDDPSQSSELLSEAKKLNDSQAPK | 400 |
| Z11403 | VDAKYAKEERAAWYEIHLLPNLTVSQMAAFISKLFDDPSQSSELLSEAKKLNDSQAPK | 401 |
| Z11404 | VDAKYAKEERKAWWEIHTLPNLTISQMAAFISKLFDDPSQSSELLSEAKKLNDSQAPK | 402 |
| Z11405 | VDAKYAKEERHAWYEIHMLPNLTIEQITAFISKLFDDPSQSSELLSEAKKLNDSQAPK | 403 |
| Z11406 | VDAKYAKEEAQAWHEIHLLPNLTVEQMAAFIQKLFDDPSQSSELLSEAKKLNDSQAPK | 404 |
| Z11407 | VDAKYAKEERKAWYEIHMLPNLTVDQIAAFISKLFDDPSQSSELLSEAKKLNDSQAPK | 405 |
| Z11408 | VDAKYAKEEAHAWWEIHKLPNLTVEQVAAFISKLFDDPSQSSELLSEAKKLNDSQAPK | 406 |
| Z11409 | VDAKYAKEERKAWWEIHLLPNLTVNQMAAFISKLFDDPSQSSELLSEAKKLNDSQAPK | 407 |
| Z11410 | VDAKYAKEEREAWYEIHLLPNLTVSQMAAFISKLFDDPSQSSELLSEAKKLNDSQAPK | 408 |
| Z11411 | VDAKYAKEEAKAWHEIHILPNLTVDQIAAFISKLFDDPSQSSELLSEAKKLNDSQAPK | 409 |
| Z11412 | VDAKYAKEERHAWYEIHTLPNLTVEQMAAFIIKLFDDPSQSSELLSEAKKLNDSQAPK | 410 |
| Z11413 | VDAKYAKEERHAWTEIHKLPNLTVQQMAAFISKLFDDPSQSSELLSEAKKLNDSQAPK | 411 |
| Z11414 | VDAKYAKEERDAWHEIHTLPNLTVNQMAAFISKLFDDPSQSSELLSEAKKLNDSQAPK | 412 |
| Z11415 | VDAKYAKEEREAWYEIHLLPNLTTNQRSAFISKLFDDPSQSSELLSEAKKLNDSQAPK | 413 |
| Z11416 | VDAKYAKEEAVAWREIHLLPNLTVNQMAAFISKLFDDPSQSSELLSEAKKLNDSQAPK | 414 |
| Z11417 | VDAKYAKEERAAWTEIHLLPNLFVDQIAAFISKLFDDPSQSSELLSEAKKLNDSQAPK | 415 |
| Z11418 | VDAKYAKEEQAAWFEIHVLPNLTIEQRAAFISKLYDDPSQSSELLSEAKKLNDSQAPK | 416 |
| Z11419 | VDAKYAKEERTAWWEIHALPNLTVQQVTAFISKLFDDPSQSSELLSEAKKLNDSQAPK | 417 |
| Z11420 | VDAKYAKEEAEAWFEIHTLPNLTVDQRVAFIIKLFDDPSQSSELLSEAKKLNDSQAPK | 418 |
| Z11421 | VDAKYAKEEREAWFEIHTLPNLTINQMAAFISKLFDDPSQSSELLSEAKKLNDSQAPK | 419 |
| Z11422 | VDAKYAKEERQAWFEIHALPNLTVQQRAAFISKLFDDPSQSSELLSEAKKLNDSQAPK | 420 |
| Z11423 | VDAKYAKEEREAWHEIHLLPNLTIDQLAAFISKLFDDPSQSSELLSEAKKLNDSQAPK | 421 |
| Z11424 | VDAKYAKEEHHAWWEIHALPNLFVDQVAAFIIKLYDDPSQSSELLSEAKKLNDSQAPK | 422 |
| Z11425 | VDAKYAKEEAKAWYEIHILPNLTVTQITAFIIKLFDDPSQSSELLSEAKKLNDSQAPK | 423 |
| Z11426 | VDAKYAKEEQQAWFEIHTLPNLTVQQVTAFISKLFDDPSQSSELLSEAKKLNDSQAPK | 424 |
| Z11427 | VDAKYAKEERTAWWEIHTLPNLTVTQMAAFISKLFDDPSQSSELLSEAKKLNDSQAPK | 425 |
| Z11428 | VDAKYAKEERAAWYEIHLLPNLTVDQMSAFIIKLFDDPSQSSELLSEAKKLNDSQAPK | 426 |
| Z11429 | VDAKYAKEEQQAWWEIHALPNLTVDQITAFISKLFDDPSQSSELLSEAKKLNDSQAPK | 427 |
| Z11430 | VDAKYAKEERRAWYEIHTLPNLTVSQMAAFIIKLFDDPSQSSELLSEAKKLNDSQAPK | 428 |
| Z11431 | VDAKYAKEEQRAWTEIHMLPNLTANQMAAFISKLFDDPSQSSELLSEAKKLNDSQAPK | 429 |

Figure 1N

| Designation | Sequence | SEQ ID NO |
|---|---|---|
| Z11432 | VDAKYAKEEHEAWYEIHVLPNLTVNQISAFISKLFDDPSQSSELLSEAKKLNDSQAPK | 430 |
| Z11434 | VDAKYAKEEADAWHEIHLLPNLTVEQMAAFIQKLFDDPSQSSELLSEAKKLNDSQAPK | 431 |
| Z11435 | VDAKYAKEEREAWFEIHALPNLTVTQMAAFISKLFDDPSQSSELLSEAKKLNDSQAPK | 432 |
| Z11436 | VDAKYAKEERDAWYEIHLLPNLTVEQMAAFIQKLFDDPSQSSELLSEAKKLNDSQAPK | 433 |
| Z11437 | VDAKYAKEERKAWFEIHLLPNLTVEQMAAFISKLFDDPSQSSELLSEAKKLNDSQAPK | 434 |
| Z11438 | VDAKYAKEEAEAWSEIHLLPNLTVEQMAAFISKLFDDPSQSSELLSEAKKLNDSQAPK | 435 |
| Z11439 | VDAKYAKEERKAWYEIHSLPNLTVNQMAAFIIKLFDDPSQSSELLSEAKKLNDSQAPK | 436 |
| Z11440 | VDAKYAKEEAAAWHEIHVLPNLTVDQMAAFIIKLYDDPSQSSELLSEAKKLNDSQAPK | 437 |
| Z11441 | VDAKYAKEERHAWTEIHKLPNLTIQQITAFISKLFDDPSQSSELLSEAKKLNDSQAPK | 438 |
| Z11442 | VDAKYAKEERRAWFEIHALPNLTVQQMVAFISKLFDDPSQSSELLSEAKKLNDSQAPK | 439 |
| Z11443 | VDAKYAKEERDAWYEIHILPNLTVNQIAAFISKLFDDPSQSSELLSEAKKLNDSQAPK | 440 |
| Z11444 | VDAKYAKEEAEAWHEIHVLPNLTVNQMAAFISKLFDDPSQSSELLSEAKKLNDSQAPK | 441 |
| Z11445 | VDAKYAKEEARAWHEIHLLPNLTIQQMAAFISKLFDDPSQSSELLSEAKKLNDSQAPK | 442 |
| Z11446 | VDAKYAKEEAQAWWEIHALPNLTVDQTAAFISKLFDDPSQSSELLSEAKKLNDSQAPK | 443 |
| Z11447 | VDAKYAKEEADAWFEIHTLPNLTVEQIAAFISKLFDDPSQSSELLSEAKKLNDSQAPK | 444 |
| Z11448 | VDAKYAKEEAAAWYEIHILPNLTVQQMAAFISKLFDDPSQSSELLSEAKKLNDSQAPK | 445 |
| Z11449 | VDAKYAKEEAEAWFEIHVLPNLTVSQIAAFISKLFDDPSQSSELLSEAKKLNDSQAPK | 446 |
| Z11450 | VDAKYAKEEQSAWYEIHLLPNLTTNQLTAFISKLFDDPSQSSELLSEAKKLNDSQAPK | 447 |
| Z11451 | VDAKYAKEEARAWYEIHTLPNLTATQMAAFISKLFDDPSQSSELLSEAKKLNDSQAPK | 448 |
| Z11452 | VDAKYAKEEADAWWEIHALPNLTVDQVTAFISKLFDDPSQSSELLSEAKKLNDSQAPK | 449 |
| Z11453 | VDAKYAKEEAHAWREIHILPNLTVNQMAAFISKLFDDPSQSSELLSEAKKLNDSQAPK | 450 |
| Z11454 | VDAKYAKEEAQAWHEIHLLPNLTVHQMAAFISKLFDDPSQSSELLSEAKKLNDSQAPK | 451 |
| Z11455 | VDAKYAKEEARAWHEIHILPNLTTDQMAAFISKLFDDPSQSSELLSEAKKLNDSQAPK | 452 |
| Z11456 | VDAKYAKEERHAWHEIHILPNLTVDQMAAFISKLFDDPSQSSELLSEAKKLNDSQAPK | 453 |
| Z11457 | VDAKYAKEERHAWREIHLLPNLTVNQMAAFISKLFDDPSQSSELLSEAKKLNDSQAPK | 454 |
| Z11458 | VDAKYAKEERTAWWEIHALPNLTVSQVAAFISKLFDDPSQSSELLSEAKKLNDSQAPK | 455 |
| Z11459 | VDAKYAKEERHAWYEIHLLPNLTVDQMAAFITKLYDDPSQSSELLSEAKKLNDSQAPK | 456 |
| Z11460 | VDAKYAKEEQRAWREIHLLPNLTVDQMAAFISKLFDDPSQSSELLSEAKKLNDSQAPK | 457 |
| Z11461 | VDAKYAKEERQAWYEIHVLPNLTVHQMAAFISKLFDDPSQSSELLSEAKKLNDSQAPK | 458 |
| Z11462 | VDAKYAKEEAQAWHEIHTLPNLTVSQMAAFISKLFDDPSQSSELLSEAKKLNDSQAPK | 459 |
| Z11463 | VDAKYAKEEREAWLEIHLLPNLTIDQMSAFISKLFDDPSQSSELLSEAKKLNDSQAPK | 460 |
| Z11464 | VDAKYAKEEHRAWFEIHLLPNLTTEQMAAFISKLFDDPSQSSELLSEAKKLNDSQAPK | 461 |
| Z11465 | VDAKYAKEERRAWYEIHLLPNLTTDQMAAFISKLFDDPSQSSELLSEAKKLNDSQAPK | 462 |

Figure 10

| Designation | Sequence | SEQ ID NO |
|---|---|---|
| Z11466 | VDAKYAKEEREAWYEIHILPNLTVSQIAAFISKLFDDPSQSSELLSEAKKLNDSQAPK | 463 |
| Z11467 | VDAKYAKEERDAWYEIHILPNLTVDQMAAFISKLFDDPSQSSELLSEAKKLNDSQAPK | 464 |
| Z11468 | VDAKYAKEERDAWYEIHLLPNLTVSQMAAFISKLFDDPSQSSELLSEAKKLNDSQAPK | 465 |
| Z11469 | VDAKYAKEERTAWFEIHSLPNLTAEQMAAFIKLYDDPSQSSELLSEAKKLNDSQAPK | 466 |
| Z11470 | VDAKYAKEEHRAWLEIHTLPNLTVDQMAAFISKLFDDPSQSSELLSEAKKLNDSQAPK | 467 |
| Z11471 | VDAKYAKEEHAAWYEIHLLPNLTVSQISAFIQKLFDDPSQSSELLSEAKKLNDSQAPK | 468 |
| Z11473 | VDAKYAKEEADAWYEIHALPNLTVDQMAAFISKLFDDPSQSSELLSEAKKLNDSQAPK | 469 |
| Z11474 | VDAKYAKEEAEAWWEIHTLPNLTLPNLFDDPSQSSELLSEAKKLNDSQAPK | 470 |
| Z11475 | VDAKYAKEEAEAWWEIHKLPNLTVEQMTAFIIKLYDDPSQSSELLSEAKKLNDSQAPK | 471 |
| Z11476 | VDAKYAKEEHHAWREIHILPNLTVEQMAAFIIKLFDDPSQSSELLSEAKKLNDSQAPK | 472 |
| Z11477 | VDAKYAKEEREAWYEIHLLPNLTIQQMAAFISKLFDDPSQSSELLSEAKKLNDSQAPK | 473 |
| Z11478 | VDAKYAKEEHAAWLEIHLLPNLTIDQMAAFISKLFDDPSQSSELLSEAKKLNDSQAPK | 474 |
| Z11479 | VDAKYAKEERAAWYEIHLLPNLTIHQMAAFISKLFDDPSQSSELLSEAKKLNDSQAPK | 475 |
| Z11480 | VDAKYAKEERTAWYEIHLLPNLTVHQMAAFISKLFDDPSQSSELLSEAKKLNDSQAPK | 476 |
| Z11481 | VDAKYAKEERHAWHEIHSLPNLTIDQLTAFISKLFDDPSQSSELLSEAKKLNDSQAPK | 477 |
| Z11482 | VDAKYAKEEREAWYEIHSLPNLTVDQVAAFISKLFDDPSQSSELLSEAKKLNDSQAPK | 478 |
| Z11483 | VDAKYAKEEHHAWHEIHTLPNLTVHQMAAFISKLFDDPSQSSELLSEAKKLNDSQAPK | 479 |
| Z11484 | VDAKYAKEEAHAWHEIHLLPNLTVEQAAAFISKLFDDPSQSSELLSEAKKLNDSQAPK | 480 |
| Z11485 | VDAKYAKEEAHAWWEIHKLPNLTVNQVAAFISKLFDDPSQSSELLSEAKKLNDSQAPK | 481 |
| Z11486 | VDAKYAKEEARAWYEIHLLPNLTVTQMAAFISKLFDDPSQSSELLSEAKKLNDSQAPK | 482 |
| Z11487 | VDAKYAKEEARAWWEIHTLPNLTVDQISAFISKLFDDPSQSSELLSEAKKLNDSQAPK | 483 |
| Z11488 | VDAKYAKEEHDAWFEIHLLPNLTVEQIAAFISKLFDDPSQSSELLSEAKKLNDSQAPK | 484 |
| Z11489 | VDAKYAKEEHTAWYEIHILPNLTVDQMAAFISKLFDDPSQSSELLSEAKKLNDSQAPK | 485 |
| Z11490 | VDAKYAKEEREAWWEIHALPNLTVNQMAAFISKLFDDPSQSSELLSEAKKLNDSQAPK | 486 |
| Z11491 | VDAKYAKEERDAWYEISTLPNLTVEQAAAFISKLFDDPSQSSELLSEAKKLNDSQAPK | 487 |
| Z11492 | VDAKYAKEEREAWYEIHLLPNLTITQMAAFISKLFDDPSQSSELLSEAKKLNDSQAPK | 488 |
| Z11493 | VDAKYAKEEAKAWFEIHTLPNLTVDQVAAFISKLFDDPSQSSELLSEAKKLNDSQAPK | 489 |
| Z11494 | VDAKYAKEEROAWWEIHTLPNLTVPNLTVEQMSAFISKLYDDPSQSSELLSEAKKLNDSQAPK | 490 |
| Z11495 | VDAKYAKEEHEAWHEIHILPNLTVEQMSAFISKLFDDPSQSSELLSEAKKLNDSQAPK | 491 |
| Z11496 | VDAKYAKEERDAWFEIHLLPNLTIDQMAAFISKLFDDPSQSSELLSEAKKLNDSQAPK | 492 |
| Z11497 | VDAKYAKEEAKAWWEIHLLPNLTVEQMAAFISKLFDDPSQSSELLSEAKKLNDSQAPK | 493 |
| Z11498 | VDAKYAKEEARAWWEIHSLPNLTVNQMAAFISKLFDDPSQSSELLSEAKKLNDSQAPK | 494 |
| Z11499 | VDAKYAKEEQKAWWEIHSLPNLTVDQITAFISKLFDDPSQSSELLSEAKKLNDSQAPK | 495 |

Figure 1P

| Designation | Sequence | SEQ ID NO |
|---|---|---|
| Z11500 | VDAKYAKEEREAWYEIHLLPNLTVSQIAAFISKLFDDPSQSSELLSEAKKLNDSQAPK | 496 |
| Z11501 | VDAKYAKEERRAWHEIQTLPNLTVRQMAAFISKLFDDPSQSSELLSEAKKLNDSQAPK | 497 |
| Z11502 | VDAKYAKEERQAWYEIHTLPNLTATQMAAFIQKLFDDPSQSSELLSEAKKLNDSQAPK | 498 |
| Z11503 | VDAKYAKEERHAWTEIHLLPNLTVNQMAAFIKLFDDPSQSSELLSEAKKLNDSQAPK | 499 |
| Z11504 | VDAKYAKEEARAWHEIHVLPNLTVNQMTAFISKLFDDPSQSSELLSEAKKLNDSQAPK | 500 |
| Z11505 | VDAKYAKEEAEAWYEIHILPNLTVNQIAAFISKLFDDPSQSSELLSEAKKLNDSQAPK | 501 |
| Z11506 | VDAKYAKEEAEAWREIHLLPNLTVDQMAAFISKLFDDPSQSSELLSEAKKLNDSQAPK | 502 |
| Z11507 | VDAKYAKEERSAWFEIHTLPNLTLPNLTVDQMAAFISKLFDDPSQSSELLSEAKKLNDSQAPK | 503 |
| Z11508 | VDAKYAKEEAQAWYEIHALPNLTVEQMAAFISKLFDDPSQSSELLSEAKKLNDSQAPK | 504 |
| Z11509 | VDAKYAKEERTAWWEIHALPNLTVNQVTAFISKLFDDPSQSSELLSEAKKLNDSQAPK | 505 |
| Z11510 | VDAKYAKEEAEAWFEIHVLPNLTTDQRVAFITKLFDDPSQSSELLSEAKKLNDSQAPK | 506 |
| Z11511 | VDAKYAKEEAEAWYEIHVLPNLTVDQMAAFIQKLFDDPSQSSELLSEAKKLNDSQAPK | 507 |
| Z11512 | VDAKYAKEEREAWLEIHLLPNLTVEQMAAFISKLFDDPSQSSELLSEAKKLNDSQAPK | 508 |
| Z11513 | VDAKYAKEERAAWWEIHSLPNLTVSQMAAFISKLFDDPSQSSELLSEAKKLNDSQAPK | 509 |
| Z11514 | VDAKYAKEEAKAWREIHLLPNLTVNQMAAFISKLFDDPSQSSELLSEAKKLNDSQAPK | 510 |
| Z11515 | VDAKYAKEERQAWHEIHALPNLTVTQMAAFISKLFDDPSQSSELLSEAKKLNDSQAPK | 511 |
| Z11516 | VDAKYAKEERDAWFEIHTLPNLTVDQMAAFIQKLFDDPSQSSELLSEAKKLNDSQAPK | 512 |
| Z11517 | VDAKYAKEERRAWYEIHSLPNLTVNQMAAFIQKLFDDPSQSSELLSEAKKLNDSQAPK | 513 |
| Z11518 | VDAKYAKEEHQAWHEIHLLPNLTVSQMAAFIQKLFDDPSQSSELLSEAKKLNDSQAPK | 514 |
| Z11519 | VDAKYAKEERHAWFEIHKLPNLTTDQIAAFIWKLFDDPSQSSELLSEAKKLNDSQAPK | 515 |
| Z11520 | VDAKYAKEEAHAWHEIHLLPNLTIDQMAAFIMKLFDDPSQSSELLSEAKKLNDSQAPK | 516 |
| Z11521 | VDAKYAKEERAAWYEIHLLPNLTIEQMSAFISKLFDDPSQSSELLSEAKKLNDSQAPK | 517 |
| Z11522 | VDAKYAKEEAKAWFEIHALPNLTTTQMAAFISKLFDDPSQSSELLSEAKKLNDSQAPK | 518 |
| Z11523 | VDAKYAKEERKAWYEIHIHLPNLTVDQMAAFISKLFDDPSQSSELLSEAKKLNDSQAPK | 519 |
| Z11524 | VDAKYAKEERQAWHEIHILPNLTITQRTAFISKLFDDPSQSSELLSEAKKLNDSQAPK | 520 |
| Z11525 | VDAKYAKEERRAWYEIHTLPNLTITQMAAFIQKLFDDPSQSSELLSEAKKLNDSQAPK | 521 |
| Z11526 | VDAKYAKEEAEAWLEIHLLPNLTVSQMAAFIWKLFDDPSQSSELLSEAKKLNDSQAPK | 522 |
| Z11527 | VDAKYAKEEAHAWWEIHALPNLTTNQMAAFISKLFDDPSQSSELLSEAKKLNDSQAPK | 523 |
| Z11528 | VDAKYAKEERHAWTEIHLLPNLTINQMVAFIIKLFDDPSQSSELLSEAKKLNDSQAPK | 524 |
| Z11529 | VDAKYAKEERQAWTEIHLLPNLTVRQMAAFISKLFDDPSQSSELLSEAKKLNDSQAPK | 525 |
| Z11530 | VDAKYAKEEAHAWHEIHTLPNLTVNQMAAFISKLFDDPSQSSELLSEAKKLNDSQAPK | 526 |
| Z11531 | VDAKYAKEERQAWHEIHILPNLTVNQMAAFISKLFDDPSQSSELLSEAKKLNDSQAPK | 527 |
| Z11532 | VDAKYAKEERHAWWEIHKLPNLTVNQMAAFISKLFDDPSQSSELLSEAKKLNDSQAPK | 528 |

Figure 1Q

| Designation | Sequence | SEQ ID NO |
|---|---|---|
| Z11533 | VDAKYAKEEAKAWFEIHKLPNLTANQMAAFIIKLYDDPSQSSELLSEAKKLNDSQAPK | 529 |
| Z11534 | VDAKYAKEEREAWYEIHILPNLTVQQRVAFISKLFDDPSQSSELLSEAKKLNDSQAPK | 530 |
| Z11535 | VDAKYAKEEQEAWHEIHILPNLTVTQMTAFISKLFDDPSQSSELLSEAKKLNDSQAPK | 531 |
| Z11536 | VDAKYAKEERQAWFEIHVLPNLTIEQMAAFISKLFDDPSQSSELLSEAKKLNDSQAPK | 532 |
| Z11537 | VDAKYAKEERQAWYEIHKLPNLTIDQMAAFIQKLFDDPSQSSELLSEAKKLNDSQAPK | 533 |
| Z11538 | VDAKYAKEEREAWWEIHLLPNLTIDQMAAFISKLFDDPSQSSELLSEAKKLNDSQAPK | 534 |
| Z11539 | VDAKYAKEERDAWYEIHTLPNLTVHQMAAFISKLFDDPSQSSELLSEAKKLNDSQAPK | 535 |
| Z11540 | VDAKYAKEEQAAWFEIHALPNLTVSQMAAFISKLFDDPSQSSELLSEAKKLNDSQAPK | 536 |
| Z11541 | VDAKYAKEEAHAWYEIHILPNLTVRQIAAFIQKLFDDPSQSSELLSEAKKLNDSQAPK | 537 |
| Z11542 | VDAKYAKEEAKAWWEIHSLPNLTAEQVSAFIQKLFDDPSQSSELLSEAKKLNDSQAPK | 538 |
| Z11543 | VDAKYAKEEQKAWHEIHILPNLTTHQRVAFISKLFDDPSQSSELLSEAKKLNDSQAPK | 539 |
| Z11544 | VDAKYAKEERQAWYEIHALPNLTVTQMAAFISKLFDDPSQSSELLSEAKKLNDSQAPK | 540 |
| Z11545 | VDAKYAKEERDAWYEIHILPNLTVSQMSAFIQKLFDDPSQSSELLSEAKKLNDSQAPK | 541 |
| Z11546 | VDAKYAKEEHDAWYEIHLLPNLTVQQMAAFISKLFDDPSQSSELLSEAKKLNDSQAPK | 542 |
| Z11547 | VDAKYAKEEAHAWREIHLLPNLTVHQRTAFISKLFDDPSQSSELLSEAKKLNDSQAPK | 543 |
| Z11548 | VDAKYAKEERHAWREIHLLPNLTHTQMAAFISKLFDDPSQSSELLSEAKKLNDSQAPK | 544 |
| Z11549 | VDAKYAKEERHAWYEIHVLPNLTIHLPNLTIQQNMAAFIQKLFDDPSQSSELLSEAKKLNDSQAPK | 545 |
| Z11550 | VDAKYAKEEARAWYEIHILPNLTIHSLPNLTVDQMSAFIIKLFDDPSQSSELLSEAKKLNDSQAPK | 546 |
| Z11551 | VDAKYAKEERDAWREIHLLPNLTVRQLSAFISKLFDDPSQSSELLSEAKKLNDSQAPK | 547 |
| Z11553 | VDAKYAKEERQAWYEIHLLPNLTQQMAAFISKLFDDPSQSSELLSEAKKLNDSQAPK | 548 |
| Z11554 | VDAKYAKEERKAWREIHTLPNLTVQQMAAFISKLFDDPSQSSELLSEAKKLNDSQAPK | 549 |
| Z11555 | VDAKYAKEERHAWLEIHKLPNLTATQMAAFISKLFDDPSQSSELLSEAKKLNDSQAPK | 550 |
| Z11556 | VDAKYAKEEREAWYEIHVLPNLTVEQMVAFIIKLYDDPSQSSELLSEAKKLNDSQAPK | 551 |
| Z11557 | VDAKYAKEERQAWFEIHTLPNLTVDQMVAFISKLFDDPSQSSELLSEAKKLNDSQAPK | 552 |
| Z11558 | VDAKYAKEEARAWYEIHSLPNLTVDQMSAFIIKLFDDPSQSSELLSEAKKLNDSQAPK | 553 |
| Z11559 | VDAKYAKEEAHAWWEIHLLPNLTVHQIAAFISKLFDDPSQSSELLSEAKKLNDSQAPK | 554 |
| Z11560 | VDAKYAKEEAQAWHEIHILPNLTIQQIAAFISKLFDDPSQSSELLSEAKKLNDSQAPK | 555 |
| Z11561 | VDAKYAKEEQDAWWEIHKLPNLTVNQMAAFISKLFDDPSQSSELLSEAKKLNDSQAPK | 556 |
| Z11562 | VDAKYAKEERAAWHEIHLLPNLTISQMAAFISKLFDDPSQSSELLSEAKKLNDSQAPK | 557 |
| Z11563 | VDAKYAKEERQAWFEIHVLPNLTTHQIAAFISKLFDDPSQSSELLSEAKKLNDSQAPK | 558 |
| Z11564 | VDAKYAKEEATAWHEIHLLPNLTITQMAAFISKLFDDPSQSSELLSEAKKLNDSQAPK | 559 |
| Z11565 | VDAKYAKEEREAWWEIHALPNLTANQMAAFISKLFDDPSQSSELLSEAKKLNDSQAPK | 560 |
| Z11566 | VDAKYAKEERKAWYEIHLLPNLTISQMTAFISKLFDDPSQSSELLSEAKKLNDSQAPK | 561 |

Figure 1R

| Designation | Sequence | SEQ ID NO |
|---|---|---|
| Z11567 | VDAKYAKEEAKAWFEIHALPNLTIQQMAAFISKLFDDPSQSSELLSEAKKLNDSQAPK | 562 |
| Z11568 | VDAKYAKEEARAWHEIHILPNLTTQQMAAFISKLFDDPSQSSELLSEAKKLNDSQAPK | 563 |
| Z11569 | VDAKYAKEEAQAWYEIHLLPNLTVSQIAAFIVKLYDDPSQSSELLSEAKKLNDSQAPK | 564 |
| Z11570 | VDAKYAKEERHAWFEIHKLPNLTVDQVSAFIIKLYDDPSQSSELLSEAKKLNDSQAPK | 565 |
| Z11571 | VDAKYAKEERQAWYEIHVLPNLTVSQMTAFISKLFDDPSQSSELLSEAKKLNDSQAPK | 566 |
| Z11572 | VDAKYAKEEADAWHEIHLLPNLTIDQMAAFISKLFDDPSQSSELLSEAKKLNDSQAPK | 567 |
| Z11573 | VDAKYAKEEASAWREIHILPNLTVNQMAAFISKLFDDPSQSSELLSEAKKLNDSQAPK | 568 |
| Z11574 | VDAKYAKEEAQAWYEIHILPNLTVDQMAAFISKLFDDPSQSSELLSEAKKLNDSQAPK | 569 |
| Z11575 | VDAKYAKEERSAWYEIHILPNLTVHQMTAFISKLFDDPSQSSELLSEAKKLNDSQAPK | 570 |
| Z11576 | VDAKYAKEEATAWREIHLLPNLTVEQMAAFISKLFDDPSQSSELLSEAKKLNDSQAPK | 571 |
| Z11577 | VDAKYAKEERTAWYEIHILPNLTVEQMTAFIQKLFDDPSQSSELLSEAKKLNDSQAPK | 572 |
| Z11578 | VDAKYAKEEAHAWHEIHILPNLTVDQVVAFISKLFDDPSQSSELLSEAKKLNDSQAPK | 573 |
| Z11579 | VDAKYAKEERRAWYEIHLLPNLTVSQMTAFISKLFDDPSQSSELLSEAKKLNDSQAPK | 574 |
| Z11580 | VDAKYAKEERKAWYEIHLLPNLTVSQMTAFISKLFDDPSQSSELLSEAKKLNDSQAPK | 575 |
| Z11581 | VDAKYAKEERRAWFEIHSLPNLTVRQIAAFIIKLFDDPSQSSELLSEAKKLNDSQAPK | 576 |
| Z11582 | VDAKYAKEERQAWTEIHVLPNLTVNQMAAFISKLFDDPSQSSELLSEAKKLNDSQAPK | 577 |
| Z11583 | VDAKYAKEEAHAWYEIHILPNLTIQQMAAFISKLFDDPSQSSELLSEAKKLNDSQAPK | 578 |
| Z11584 | VDAKYAKEERSAWYEIHLLPNLTVDQMTAFIQKLFDDPSQSSELLSEAKKLNDSQAPK | 579 |
| Z11585 | VDAKYAKEERHAWWEIHTLPNLTVDQMVAFISKLFDDPSQSSELLSEAKKLNDSQAPK | 580 |
| Z11586 | VDAKYAKEERAAWFEIHMLPNLTVEQMAAFISKLFDDPSQSSELLSEAKKLNDSQAPK | 581 |
| Z11587 | VDAKYAKEERTAWYEIHALPNLTVDQMVAFISKLFDDPSQSSELLSEAKKLNDSQAPK | 582 |
| Z11588 | VDAKYAKEERQAWWEIHALPNLTVSQMAAFISKLFDDPSQSSELLSEAKKLNDSQAPK | 583 |
| Z11589 | VDAKYAKEERAAWYEIHLLPNLTVEQMAAFISKLFDDPSQSSELLSEAKKLNDSQAPK | 584 |
| Z11590 | VDAKYAKEEQAWWEIHALPNLTIDQMTAFISKLFDDPSQSSELLSEAKKLNDSQAPK | 585 |
| Z11591 | VDAKYAKEERRAWFEIHLLPNLTVRQMAAFISKLFDDPSQSSELLSEAKKLNDSQAPK | 586 |
| Z11592 | VDAKYAKEERHAWWEIHLLPNLTVDQMVAFISKLFDDPSQSSELLSEAKKLNDSQAPK | 587 |
| Z11593 | VDAKYAKEERKAWWEIHLLPNLTVTQIAAFISKLFDDPSQSSELLSEAKKLNDSQAPK | 588 |
| Z11594 | VDAKYAKEERRAWFEIHSLPNLTVHQMAAFISKLFDDPSQSSELLSEAKKLNDSQAPK | 589 |
| Z11595 | VDAKYAKEEAAAWWEIHMLPNLTVSQMAAFISKLFDDPSQSSELLSEAKKLNDSQAPK | 590 |
| Z11596 | VDAKYAKEEAKAWHEIHLLPNLTVHQMAAFIIKLFDDPSQSSELLSEAKKLNDSQAPK | 591 |
| Z11597 | VDAKYAKEERFEAWYEIHALPNLTVEQMAAFISKLFDDPSQSSELLSEAKKLNDSQAPK | 592 |
| Z11598 | VDAKYAKEERKAWTEIHLLPNLTIRQMAAFISKLFDDPSQSSELLSEAKKLNDSQAPK | 593 |
| Z11599 | VDAKYAKEEAWYEIHALPNLTVQQMSAFISKLFDDPSQSSELLSEAKKLNDSQAPK | 594 |

Figure 1S

| Designation | Sequence | SEQ ID NO |
|---|---|---|
| Z11600 | VDAKYAKEERQAWFEIHTLPNLTANQMAAFIIKLYDDPSQSSELLSEAKKLNDSQAPK | 595 |
| Z11601 | VDAKYAKEERHAWYEIHTLPNLTVQQMAAFISKLFDDPSQSSELLSEAKKLNDSQAPK | 596 |
| Z11602 | VDAKYAKEERRAWYEIHLLPNLTVNQMVAFISKLFDDPSQSSELLSEAKKLNDSQAPK | 597 |
| Z11603 | VDAKYAKEERHAWYEIHLLPNLTVEQMAAFISKLFDDPSQSSELLSEAKKLNDSQAPK | 598 |
| Z11604 | VDAKYAKEERKAWYEIHLLPNLTVDQMAAFISKLFDDPSQSSELLSEAKKLNDSQAPK | 599 |
| Z11605 | VDAKYAKEERSAWWEIHTLPNLTVDQMVAFISKLFDDPSQSSELLSEAKKLNDSQAPK | 600 |
| Z11606 | VDAKYAKEEARAWFEIHTLPNLTVDQMAAFISKLFDDPSQSSELLSEAKKLNDSQAPK | 601 |
| Z11607 | VDAKYAKEERRAWYEIHSLPNLTVTQMVAFISKLFDDPSQSSELLSEAKKLNDSQAPK | 602 |
| Z11608 | VDAKYAKEEARAWHEIHVLPNLTVEQMTAFIIKLFDDPSQSSELLSEAKKLNDSQAPK | 603 |
| Z11609 | VDAKYAKEERDAWYEIHLLPNLTIDQMAAFIQKLFDDPSQSSELLSEAKKLNDSQAPK | 604 |
| Z11610 | VDAKYAKEEREAWWEIHLLPNLTIRQMAAFISKLFDDPSQSSELLSEAKKLNDSQAPK | 605 |
| Z11618 | VDAKYAKEEQQAWYEIHLLPNLTVEQMAAFISKLFDDPSQSSELLSEAKKLNDSQAPK | 606 |
| Z11619 | VDAKYAKEERDAWWEIHALPNLTVNQMAAFISKLFDDPSQSSELLSEAKKLNDSQAPK | 607 |
| Z11620 | VDAKYAKEEARAWYEIHILPNLTVTQMAAFIQKLFDDPSQSSELLSEAKKLNDSQAPK | 608 |
| Z11621 | VDAKYAKEERVAWYEIHMLPNLTVSQMAAFISKLFDDPSQSSELLSEAKKLNDSQAPK | 609 |
| Z11622 | VDAKYAKEERTAWWEIHALPNLTVQQRSAFISKLFDDPSQSSELLSEAKKLNDSQAPK | 610 |
| Z11623 | VDAKYAKEEAKAWYEIHLLPNLTVRQMAAFISKLFDDPSQSSELLSEAKKLNDSQAPK | 611 |
| Z11624 | VDAKYAKEEAKAWYEIHLLPNLTVNQMAAFIWKLLDDPSQSSELLSEAKKLNDSQAPK | 612 |
| Z11625 | VDAKYAKEERQAWYEIHTLPNLTVRQMVAFISKLFDDPSQSSELLSEAKKLNDSQAPK | 613 |
| Z11626 | VDAKYAKEERKAWWEIHLLPNLTIDQMSAFISKLFDDPSQSSELLSEAKKLNDSQAPK | 614 |
| Z11627 | VDAKYAKEERKAWYEIHALPNLTPNLTVTQMAAFISKLFDDPSQSSELLSEAKKLNDSQAPK | 615 |
| Z11628 | VDAKYAKEEAHAWREIHLLPNLTVEQMAAFIQKLFDDPSQSSELLSEAKKLNDSQAPK | 616 |
| Z11629 | VDAKYAKEERHAWHEIHLLPNLTVQQIAAFISKLFDDPSQSSELLSEAKKLNDSQAPK | 617 |
| Z11630 | VDAKYAKEERDAWFEIHALPNLTANQMAAFISKLFDDPSQSSELLSEAKKLNDSQAPK | 618 |
| Z11631 | VDAKYAKEEAKAWYEIHLLPNLTVNQMAAFIIKLFDDPSQSSELLSEAKKLNDSQAPK | 619 |
| Z11633 | VDAKYAKEERDAWFEIHSLPNLTVSQMAAFISKLFDDPSQSSELLSEAKKLNDSQAPK | 620 |
| Z11634 | VDAKYAKEERKAWWEIHVLPNLTVDQMAAFISKLFDDPSQSSELLSEAKKLNDSQAPK | 621 |
| Z11635 | VDAKYAKEEAHAWYEIHTLPNLTVNQMAAFIQKLFDDPSQSSELLSEAKKLNDSQAPK | 622 |
| Z11636 | VDAKYAKEEARAWREIHTLPNLTVEQMAAFISKLFDDPSQSSELLSEAKKLNDSQAPK | 623 |
| Z11637 | VDAKYAKEERRAWTEIHLLPNLTVHQMVAFISKLFDDPSQSSELLSEAKKLNDSQAPK | 624 |
| Z11638 | VDAKYAKEEAHAWHEIHTLPNLTIDQMVAFISKLFDDPSQSSELLSEAKKLNDSQAPK | 625 |
| Z11639 | VDAKYAKEERQAWYEIHLLPNLTVHQMAAFISKLFDDPSQSSELLSEAKKLNDSQAPK | 626 |
| Z11640 | VDAKYAKEERRAWWEIHLLPNLTVRQMAAFISKLFDDPSQSSELLSEAKKLNDSQAPK | 627 |

Figure 1T

| Designation | Sequence | SEQ ID NO |
|---|---|---|
| Z11641 | VDAKYAKEEAHAWTEIHKLPNLTVDQMTAFIIKLYDDPSQSSELLSEAKKLNDSQAPK | 628 |
| Z11643 | VDAKYAKEEARAWREIHLLPNLTVTQMAAFISKLFDDPSQSSELLSEAKKLNDSQAPK | 629 |
| Z11645 | VDAKYAKEERQAWWEIHSLPNLTTEQMVAFISKLFDDPSQSSELLSEAKKLNDSQAPK | 630 |
| Z11646 | VDAKYAKEERDAWYEIHLLPNLTIQQMAAFIQKLFDDPSQSSELLSEAKKLNDSQAPK | 631 |
| Z11647 | VDAKYAKEERTAWWEIHKLPNLTTEQMAAFISKLFDDPSQSSELLSEAKKLNDSQAPK | 632 |
| Z11648 | VDAKYAKEERDAWYEIHILPNLTTEQMAAFISKLFDDPSQSSELLSEAKKLNDSQAPK | 633 |
| Z11649 | VDAKYAKEEREAAWEIHSLPNLTAHQMAAFIIKLFDDPSQSSELLSEAKKLNDSQAPK | 634 |
| Z11650 | VDAKYAKEERKAWYEIHSLPNLTVSQMSAFISKLFDDPSQSSELLSEAKKLNDSQAPK | 635 |
| Z11651 | VDAKYAKEERHAWFEIHALPNLTVSQMVAFISKLFDDPSQSSELLSEAKKLNDSQAPK | 636 |
| Z11652 | VDAKYAKEERHAWREIHLLPNLTTEQMSAFIQKLFDDPSQSSELLSEAKKLNDSQAPK | 637 |
| Z11653 | VDAKYAKEEHRAWTEIHTLPNLTVDQMAAFISKLFDDPSQSSELLSEAKKLNDSQAPK | 638 |
| Z11654 | VDAKYAKEERDAWYEIHLLPNLTTQQRAAFIVKLFDDPSQSSELLSEAKKLNDSQAPK | 639 |
| Z11655 | VDAKYAKEEAQAWWEIHALPNLTVSQMVAFIMKLFDDPSQSSELLSEAKKLNDSQAPK | 640 |
| Z11656 | VDAKYAKEEREAAWWEIHALPNLTVNQVVAFISKLFDDPSQSSELLSEAKKLNDSQAPK | 641 |
| Z11657 | VDAKYAKEERQAWYEIHVLPNLTVNQMAAFISKLFDDPSQSSELLSEAKKLNDSQAPK | 642 |
| Z11658 | VDAKYAKEERSAWYEIHLLPNLTVHQMTAFISKLFDDPSQSSELLSEAKKLNDSQAPK | 643 |
| Z11659 | VDAKYAKEEAKAWYEIHILPNLTVHQIAAFISKLFDDPSQSSELLSEAKKLNDSQAPK | 644 |
| Z11660 | VDAKYAKEEQQAWLEIHTLPNLTVSQMVAFISKLFDDPSQSSELLSEAKKLNDSQAPK | 645 |
| Z11661 | VDAKYAKEEAHAWREIHLLPNLTVTQMAAFISKLFDDPSQSSELLSEAKKLNDSQAPK | 646 |
| Z11662 | VDAKYAKEEAAWFEIHLLPNLTIHQMAAFISKLFDDPSQSSELLSEAKKLNDSQAPK | 647 |
| Z11663 | VDAKYAKEEQQAWYEIHTLPNLTINQMAAFISKLFDDPSQSSELLSEAKKLNDSQAPK | 648 |
| Z11664 | VDAKYAKEERDAWYEIHTLPNLTVNQITAFISKLFDDPSQSSELLSEAKKLNDSQAPK | 649 |
| Z11665 | VDAKYAKEEAHAWYEIHILPNLTVSQMVAFISKLFDDPSQSSELLSEAKKLNDSQAPK | 650 |
| Z11666 | VDAKYAKEERRAWWEIHALPNLTVSQMVAFISKLFDDPSQSSELLSEAKKLNDSQAPK | 651 |
| Z11667 | VDAKYAKEEAQAWYEIHTLPNLTVHQMAAFISKLFDDPSQSSELLSEAKKLNDSQAPK | 652 |
| Z11668 | VDAKYAKEERAAWFEIHLLPNLTVEQMTAFIHKLYDDPSQSSELLSEAKKLNDSQAPK | 653 |
| Z11669 | VDAKYAKEEAHAWREIHLLPNLTITQMAAFIQKLFDDPSQSSELLSEAKKLNDSQAPK | 654 |
| Z11670 | VDAKYAKEEARAWHEIHVLPNLTVTQVVAFISKLFDDPSQSSELLSEAKKLNDSQAPK | 655 |
| Z11671 | VDAKYAKEEAKAWHEIHVLPNLTVSQIAAFISKLFDDPSQSSELLSEAKKLNDSQAPK | 656 |
| Z11672 | VDAKYAKEEHRAWYEIHLLPNLTINQMAAFISKLFDDPSQSSELLSEAKKLNDSQAPK | 657 |
| Z11673 | VDAKYAKEERTAWYEIHLLPNLTVRQMVAFISKLFDDPSQSSELLSEAKKLNDSQAPK | 658 |
| Z11675 | VDAKYAKEERKAWYEIHLLPNLTIQQIAAFISKLFDDPSQSSELLSEAKKLNDSQAPK | 659 |
| Z11676 | VDAKYAKEERRAWYEIHLLPNLTTQQMAAFIQKLFDDPSQSSELLSEAKKLNDSQAPK | 660 |

Figure 1U

| Designation | Sequence | SEQ ID NO |
|---|---|---|
| Z11677 | VDAKYAKEEREAWHEIHLLPNLTVTQMAAFIIKLFDDPSQSSELLSEAKKLNDSQAPK | 661 |
| Z11678 | VDAKYAKEEARAWWEIHLLPNLTVEQMAAFIHLLPNLTVEQMAAFISKLFDDPSQSSELLSEAKKLNDSQAPK | 662 |
| Z11679 | VDAKYAKEERQAWWEIHILPNLTVTQMAAFISKLFDDPSQSSELLSEAKKLNDSQAPK | 663 |
| Z11680 | VDAKYAKEEAQAWREIHTLPNLTANQMAAFIIKLYDDPSQSSELLSEAKKLNDSQAPK | 664 |
| Z11681 | VDAKYAKEERHAWTEIHLLPNLTTISQMAAFISKLFDDPSQSSELLSEAKKLNDSQAPK | 665 |
| Z11682 | VDAKYAKEEARAWWEIHMLPNLTVTQMAAFISKLFDDPSQSSELLSEAKKLNDSQAPK | 666 |
| Z11683 | VDAKYAKEEREAWWEIHLLPNLTAEQMAAFISKLFDDPSQSSELLSEAKKLNDSQAPK | 667 |
| Z11684 | VDAKYAKEEATAWWEIHLLPNLTVTQMAAFIQKLFDDPSQSSELLSEAKKLNDSQAPK | 668 |
| Z11685 | VDAKYAKEEAKAWHEIHLLPNLTVNQMAAFISKLFDDPSQSSELLSEAKKLNDSQAPK | 669 |
| Z11686 | VDAKYAKEERRAWYEIHLLPNLTITQMTAFISKLFDDPSQSSELLSEAKKLNDSQAPK | 670 |
| Z11687 | VDAKYAKEERRAWYEIHLLPNLTVHQIAAFISKLFDDPSQSSELLSEAKKLNDSQAPK | 671 |
| Z11688 | VDAKYAKEEHEAWWEIHLLPNLTVTQMAAFISKLFDDPSQSSELLSEAKKLNDSQAPK | 672 |
| Z11689 | VDAKYAKEERKAWTEIHSLPNLTVDQMSAFISKLFDDPSQSSELLSEAKKLNDSQAPK | 673 |
| Z11690 | VDAKYAKEEAKAWFEIHLLPNLTINQMAAFISKLFDDPSQSSELLSEAKKLNDSQAPK | 674 |
| Z11691 | VDAKYAKEERDAWYEIHVLPNLTIEQMSAFISKLFDDPSQSSELLSEAKKLNDSQAPK | 675 |
| Z11692 | VDAKYAKEEAHAWWEIHALPNLTVTQMAAFISKLFDDPSQSSELLSEAKKLNDSQAPK | 676 |
| Z11693 | VDAKYAKEEAKAWYEIHLLPNLTVTQMAAFISKLFDDPSQSSELLSEAKKLNDSQAPK | 677 |
| Z11694 | VDAKYAKEERDAWWEIHKLPNLTVSQMAAFIQKLFDDPSQSSELLSEAKKLNDSQAPK | 678 |
| Z11695 | VDAKYAKEERDAWFEIHALPNLTVNQMAAFISKLFDDPSQSSELLSEAKKLNDSQAPK | 679 |
| Z11696 | VDAKYAKEERAAWWEIHLLPNLTVQQMAAFISKLFDDPSQSSELLSEAKKLNDSQAPK | 680 |
| Z11697 | VDAKYAKEEQQAWYEIHLLPNLTVTQMAAFIIKLFDDPSQSSELLSEAKKLNDSQAPK | 681 |
| Z11699 | VDAKYAKEEADAWFEIHILPNLTIDQMAAFISKLFDDPSQSSELLSEAKKLNDSQAPK | 682 |
| Z11700 | VDAKYAKEEREAWHEIHTLPNLTVDQMAAFISKLFDDPSQSSELLSEAKKLNDSQAPK | 683 |
| Z11701 | VDAKYAKEEATAWFEIHTLPNLTVSQMAAFIWKLFDDPSQSSELLSEAKKLNDSQAPK | 684 |
| Z11702 | VDAKYAKEEAAAWHEIHILPNLTHHQMAAFIQKLFDDPSQSSELLSEAKKLNDSQAPK | 685 |
| Z11703 | VDAKYAKEERDAWFEIHALPNLTVNQMAAFISKLFDDPSQSSELLSEAKKLNDSQAPK | 686 |
| Z11704 | VDAKYAKEERKAWYEIHLLPNLTTSQHAAFISKLFDDPSQSSELLSEAKKLNDSQAPK | 687 |
| Z11705 | VDAKYAKEERDAWYEIHLLPNLTVRQMSAFIIKLFDDPSQSSELLSEAKKLNDSQAPK | 688 |
| Z11706 | VDAKYAKEEAVAWHEIHALPNLTVDQMAAFIQKLFDDPSQSSELLSEAKKLNDSQAPK | 689 |
| Z11707 | VDAKYAKEEAKANFEIHALPNLTIEQMVAFISKLFDDPSQSSELLSEAKKLNDSQAPK | 690 |
| Z11708 | VDAKYAKEEADAWWEIHSLPNLTVQQMAAFIWKLFDDPSQSSELLSEAKKLNDSQAPK | 691 |
| Z11709 | VDAKYAKEEAAAWWEIHSLPNLTVSQMAAFIWKLFDDPSQSSELLSEAKKLNDSQAPK | 692 |
| Z11710 | VDAKYAKEEAKAWHEIHTLPNLTVDQMAAFISKLFDDPSQSSELLSEAKKLNDSQAPK | 693 |

Figure 1V

| Designation | Sequence | SEQ ID NO |
|---|---|---|
| Z11712 | VDAKYAKEEAQAWWEIHILPNLTVNQIAAFISKLFDDPSQSSELLSEAKKLNDSQAPK | 694 |
| Z11713 | VDAKYAKEERSAWFEIHVLPNLTIRQMSAFISKLFDDPSQSSELLSEAKKLNDSQAPK | 695 |
| Z11714 | VDAKYAKEERRAWLEIHLLPNLTVTQMTAFISKLFDDPSQSSELLSEAKKLNDSQAPK | 696 |
| Z11715 | VDAKYAKEERAAWFEIHLLPNLTATQIAAFISKLFDDPSQSSELLSEAKKLNDSQAPK | 697 |
| Z11716 | VDAKYAKEERAAWHEIHVLPNLTIHQMAAFISKLFDDPSQSSELLSEAKKLNDSQAPK | 698 |
| Z11717 | VDAKYAKEEARAWYEIHTLPNLTTHQMAAFISKLFDDPSQSSELLSEAKKLNDSQAPK | 699 |
| Z11718 | VDAKYAKEEAEAWFEIHALPNLTVHQMAAFIQKLFDDPSQSSELLSEAKKLNDSQAPK | 700 |
| Z11719 | VDAKYAKEERAAWYEIHSLPNLTTNQMAAFISKLFDDPSQSSELLSEAKKLNDSQAPK | 701 |
| Z11720 | VDAKYAKEEAKAWHEIHVLPNLTTEQRAAFISKLFDDPSQSSELLSEAKKLNDSQAPK | 702 |
| Z11721 | VDAKYAKEERTAWYEIHVLPNLTATQMAAFISKLFDDPSQSSELLSEAKKLNDSQAPK | 703 |
| Z11722 | VDAKYAKEERRAWWEIHLLPNLTVDQMSAFISKLFDDPSQSSELLSEAKKLNDSQAPK | 704 |
| Z11724 | VDAKYAKEEADAWREIHLLPNLTVTQTAAFISKLFDDPSQSSELLSEAKKLNDSQAPK | 705 |
| Z11725 | VDAKYAKEERDAWFEIHVLPNLTTEQMVAFISKLFDDPSQSSELLSEAKKLNDSQAPK | 706 |
| Z11726 | VDAKYAKEEQQAWYEIHVLPNLTVSQMAAFISKLFDDPSQSSELLSEAKKLNDSQAPK | 707 |
| Z11727 | VDAKYAKEERRAWFEIHALPNLTVNQMVAFISKLFDDPSQSSELLSEAKKLNDSQAPK | 708 |
| Z11728 | VDAKYAKEERKAWFEIHSLPNLTATQMHAFISKLFDDPSQSSELLSEAKKLNDSQAPK | 709 |
| Z11729 | VDAKYAKEEQQAWLEIHLLPNLTVEQMTAFIHKLYDDPSQSSELLSEAKKLNDSQAPK | 710 |
| Z11730 | VDAKYAKEEAEAWLEIHVLPNLTVHQMAAFISKLFDDPSQSSELLSEAKKLNDSQAPK | 711 |
| Z11731 | VDAKYAKEERDAWHEIHLLPNLTINQMTAFISKLFDDPSQSSELLSEAKKLNDSQAPK | 712 |
| Z11732 | VDAKYAKEERRAWYEIHILPNLTVHQMTAFIQKLLDDPSQSSELLSEAKKLNDSQAPK | 713 |
| Z11733 | VDAKYAKEEARAWHEIHVLPNLTVDQTTAFISKLFDDPSQSSELLSEAKKLNDSQAPK | 714 |
| Z11734 | VDAKYAKEERQAWREIHTLPNLTVHQMAAFISKLFDDPSQSSELLSEAKKLNDSQAPK | 715 |
| Z11735 | VDAKYAKEEHDAWREIHTLPNLTVSQMAAFISKLFDDPSQSSELLSEAKKLNDSQAPK | 716 |
| Z11736 | VDAKYAKEERAAWWEIHTLPNLTVHQMAAFISKLFDDPSQSSELLSEAKKLNDSQAPK | 717 |
| Z11737 | VDAKYAKEEAKAWHEIHALPNLTVSQMAAFISKLFDDPSQSSELLSEAKKLNDSQAPK | 718 |
| Z11738 | VDAKYAKEERDAWHEIHTLPNLTVDQMAAFISKLFDDPSQSSELLSEAKKLNDSQAPK | 719 |
| Z11739 | VDAKYAKEERQAWFEIHKLPNLTVNQMAAFISKLFDDPSQSSELLSEAKKLNDSQAPK | 720 |
| Z11740 | VDAKYAKEERSAWREIHVLPNLTVPNLTVNQRAAFISKLFDDPSQSSELLSEAKKLNDSQAPK | 721 |
| Z11741 | VDAKYAKEEAAAWHEIHLLPNLTVTQIAAFISKLFDDPSQSSELLSEAKKLNDSQAPK | 722 |
| Z11742 | VDAKYAKEEREAWAEIHKLPNLTATQMHAFIHKLYDDPSQSSELLSEAKKLNDSQAPK | 723 |
| Z11743 | VDAKYAKEEQRAWSEIHSLPNLTIDQITAFIHKLYDDPSQSSELLSEAKKLNDSQAPK | 724 |
| Z11744 | VDAKYAKEEAKAWWEIHVLPNLTIDQITAFIMKLYDDPSQSSELLSEAKKLNDSQAPK | 725 |
| Z11745 | VDAKYAKEEAQAWWEIHTLPNLTVDQMAAFISKLFDDPSQSSELLSEAKKLNDSQAPK | 726 |

Figure 1W

| Designation | Sequence | SEQ ID NO |
|---|---|---|
| Z11746 | VDAKYAKEERRAWHEIHILPNLTTSQMAAFIQKLFDDPSQSSELLSEAKKLNDSQAPK | 727 |
| Z11747 | VDAKYAKEERSAWYEIHTLPNLTTNQRTAFISKLFDDPSQSSELLSEAKKLNDSQAPK | 728 |
| Z11748 | VDAKYAKEERRAWFEIHMLPNLTTDQMAAFISKLFDDPSQSSELLSEAKKLNDSQAPK | 729 |
| Z11749 | VDAKYAKEEAKAWYEIHALPNLTVDQMVAFITKLFDDPSQSSELLSEAKKLNDSQAPK | 730 |
| Z11750 | VDAKYAKEEHVAWLEIHLLPNLTAEQMAAFISKLYDDPSQSSELLSEAKKLNDSQAPK | 731 |
| Z11751 | VDAKYAKEERDAWFEIHALPNLTVQQMAAFISKLFDDPSQSSELLSEAKKLNDSQAPK | 732 |
| Z11752 | VDAKYAKEEARAWREIHLLPNLTVDQMAAFISKLFDDPSQSSELLSEAKKLNDSQAPK | 733 |
| Z11753 | VDAKYAKEEARAWWEIHMLPNLTINQMAAFISKLFDDPSQSSELLSEAKKLNDSQAPK | 734 |
| Z11754 | VDAKYAKEEAAAWLEIHKLPNLTVHQMAAFISKLFDDPSQSSELLSEAKKLNDSQAPK | 735 |
| Z11755 | VDAKYAKEERQAWFEIHVLPNLTTDQMAAFIHKLYDDPSQSSELLSEAKKLNDSQAPK | 736 |
| Z11756 | VDAKYAKEEQRAWTEIHLLPNLTVNQMAAFISKLFDDPSQSSELLSEAKKLNDSQAPK | 737 |
| Z11757 | VDAKYAKEEQQAWYEIHTLPNLTVQQMAAFIQKLFDDPSQSSELLSEAKKLNDSQAPK | 738 |
| Z11758 | VDAKYAKEEQHAWREIHILPNLTVTQIAAFISKLFDDPSQSSELLSEAKKLNDSQAPK | 739 |
| Z11759 | VDAKYAKEEQRAWYEIHLLPNLTVTQMAAFISKLFDDPSQSSELLSEAKKLNDSQAPK | 740 |
| Z11760 | VDAKYAKEERAAWFEIHSLPNLTVSQMAAFISKLFDDPSQSSELLSEAKKLNDSQAPK | 741 |
| Z11761 | VDAKYAKEERQAWYEIHILPNLTAEQMAAFISKLFDDPSQSSELLSEAKKLNDSQAPK | 742 |
| Z11762 | VDAKYAKEEAQAWWEIHVLPNLTVRQIVAFISKLFDDPSQSSELLSEAKKLNDSQAPK | 743 |
| Z11763 | VDAKYAKEERRAWFEIHTLPNLTVHQMTAFIQKLFDDPSQSSELLSEAKKLNDSQAPK | 744 |
| Z11764 | VDAKYAKEEQRAWHEIHLLPNLTTRQMAAFISKLFDDPSQSSELLSEAKKLNDSQAPK | 745 |
| Z11765 | VDAKYAKEERHAWHEIHILPNLTIEQMVAFISKLFDDPSQSSELLSEAKKLNDSQAPK | 746 |
| Z11766 | VDAKYAKEERQAWFEIHALPNLTVQQVEAFISKLFDDPSQSSELLSEAKKLNDSQAPK | 747 |
| Z11767 | VDAKYAKEEQRAWREIHLLPNLTVQQMTAFIQMTAFISKLFDDPSQSSELLSEAKKLNDSQAPK | 748 |
| Z11768 | VDAKYAKEERHAWWEIHSLPNLTISQMAAFISKLFDDPSQSSELLSEAKKLNDSQAPK | 749 |
| Z11769 | VDAKYAKEEARAWLEIHALPNLTVDQMAAFISKLFDDPSQSSELLSEAKKLNDSQAPK | 750 |
| Z11770 | VDAKYAKEERHAWFEIHKLPNLTVEQMAAFIWKLFDDPSQSSELLSEAKKLNDSQAPK | 751 |
| Z11771 | VDAKYAKEERHAWYEIHLLPNLTINQIAAFISKLFDDPSQSSELLSEAKKLNDSQAPK | 752 |
| Z11772 | VDAKYAKEERDAWYEIHLLPNLTVTQMTAFISKLFDDPSQSSELLSEAKKLNDSQAPK | 753 |
| Z11773 | VDAKYAKEEQAWHEIHILPNLTVQMTAFISKLFDDPSQSSELLSEAKKLNDSQAPK | 754 |
| Z11774 | VDAKYAKEERQAWTEIHSLPNLTATQVAAFIQKLFDDPSQSSELLSEAKKLNDSQAPK | 755 |
| Z11775 | VDAKYAKEEREAWWEIHHLPNLTVHQRAAFISKLFDDPSQSSELLSEAKKLNDSQAPK | 756 |
| Z11776 | VDAKYAKEERAAWYEIHTLPNLTVSQMTAFIQMEAFIQKLFDDPSQSSELLSEAKKLNDSQAPK | 757 |
| Z11777 | VDAKYAKEEHQAWWEIHLLPNLTARQMEAFIQKLFDDPSQSSELLSEAKKLNDSQAPK | 758 |
| Z11778 | VDAKYAKEEAHAWTEIHLLPNLTVDQMVAFISKLFDDPSQSSELLSEAKKLNDSQAPK | 759 |

Figure 1X

| Designation | Sequence | SEQ ID NO |
|---|---|---|
| Z11779 | VDAKYAKEERRAWHEIHLLPNLTIQQIAAFISKLFDDPSQSSELLSEAKKLNDSQAPK | 760 |
| Z11780 | VDAKYAKEEHDAWFEIHTLPNLTVEQMAAFIMKLFDDPSQSSELLSEAKKLNDSQAPK | 761 |
| Z11782 | VDAKYAKEEHRAWLEIHLLPNLTVRQMAAFISKLFDDPSQSSELLSEAKKLNDSQAPK | 762 |
| Z11783 | VDAKYAKEEAKAWWEIHLLPNLTVDQMAAFISKLFDDPSQSSELLSEAKKLNDSQAPK | 763 |
| Z11785 | VDAKYAKEERKAWHEIHVLPNLTTNQRVAFIMKLMDDPSQSSELLSEAKKLNDSQAPK | 764 |
| Z11786 | VDAKYAKEERRAWWEIHILPNLTVEQAAAFISKLFDDPSQSSELLSEAKKLNDSQAPK | 765 |
| Z11787 | VDAKYAKEEAAAWYEIHTLPNLTIDQMAAFIQKLFDDPSQSSELLSEAKKLNDSQAPK | 766 |
| Z11790 | VDAKYAKEERAAWFEIHKLPNLTVSQMAAFIQKLFDDPSQSSELLSEAKKLNDSQAPK | 767 |
| Z11792 | VDAKYAKEEAEAWTEIHKLPNLTVHQMTAFIIKLFDDPSQSSELLSEAKKLNDSQAPK | 768 |
| Z11793 | VDAKYAKEERHAWWEIHKLPNLTISQMAAFITSQRVAFISKLFDDPSQSSELLSEAKKLNDSQAPK | 769 |
| Z11795 | VDAKYAKEERKAWYEIHLLPNLTTSQRVAFISKLFDDPSQSSELLSEAKKLNDSQAPK | 770 |
| Z11796 | VDAKYAKEEASAWWEIHVLPNLTVNQIAAFISKLFDDPSQSSELLSEAKKLNDSQAPK | 771 |
| Z11797 | VDAKYAKEERDAWYEIHLLPNLTTDQMAAFISKLFDDPSQSSELLSEAKKLNDSQAPK | 772 |
| Z11798 | VDAKYAKEEAEAWLEIHLLPNLTVQQMAAFISKLFDDPSQSSELLSEAKKLNDSQAPK | 773 |
| Z11799 | VDAKYAKEEAKAWHEIHVLPNLTVRQIAAFISKLFDDPSQSSELLSEAKKLNDSQAPK | 774 |
| Z11800 | VDAKYAKEEASAWFEIHTLPNLTVDQMSAFIIKLFDDPSQSSELLSEAKKLNDSQAPK | 775 |
| Z11801 | VDAKYAKEERKAWYEIHVLPNLTVEQIAAFISKLFDDPSQSSELLSEAKKLNDSQAPK | 776 |
| Z11804 | VDAKYAKEERAAWHEIHKLPNLTTEQRVAFIIKLYDDPSQSSELLSEAKKLNDSQAPK | 777 |
| Z11806 | VDAKYAKEEAQAWYEIHVLPNLTVRQMVAFISKLFDDPSQSSELLSEAKKLNDSQAPK | 778 |
| Z11807 | VDAKYAKEEAQAWWEIHLLPNLTVRQIAAFISKLFDDPSQSSELLSEAKKLNDSQAPK | 779 |
| Z11808 | VDAKYAKEEAAAWTEIHALPNLTVHQMAAFISKLFDDPSQSSELLSEAKKLNDSQAPK | 780 |
| Z11809 | VDAKYAKEERTAWWEIHALPNLTIDQMAAFIIKLYDDPSQSSELLSEAKKLNDSQAPK | 781 |
| Z11810 | VDAKYAKEEHKAWREIHLLPNLFTEQMTAFISKLFDDPSQSSELLSEAKKLNDSQAPK | 782 |
| Z11811 | VDAKYAKEEQRAWREIHLLPNLTVNQMAAFITKLFDDPSQSSELLSEAKKLNDSQAPK | 783 |
| Z11812 | VDAKYAKEEHAWWEIHKLPNLTIRQMAAFISKLFDDPSQSSELLSEAKKLNDSQAPK | 784 |
| Z11813 | VDAKYAKEEARAWHEIHILPNLTVRQISAFISKLFDDPSQSSELLSEAKKLNDSQAPK | 785 |
| Z11816 | VDAKYAKEERQAWFETHALPNLTVNQMAAFIIKLYDDPSQSSELLSEAKKLNDSQAPK | 786 |
| Z11820 | VDAKYAKEEAQAWSEIHLLPNLTIDQRVAFISKLFDDPSQSSELLSEAKKLNDSQAPK | 787 |
| Z11821 | VDAKYAKEERHAWHEIHILPNLTIDQMAAFIINQMAAFISKLFDDPSQSSELLSEAKKLNDSQAPK | 788 |
| Z11822 | VDAKYAKEEAKANAEIHALPNLTVTQMSAFIQKLFDDPSQSSELLSEAKKLNDSQAPK | 789 |
| Z11825 | VDAKYAKEERQAWFEIHILPNLTATQMAAFISKLFDDPSQSSELLSEAKKLNDSQAPK | 790 |
| Z11826 | VDAKYAKEERRAWALEIHALPNLTVRQMAAFISKLFDDPSQSSELLSEAKKLNDSQAPK | 791 |
| Z11827 | VDAKYAKEEAHAWFEIHILPNLTIDQRSAFISKLFDDPSQSSELLSEAKKLNDSQAPK | 792 |

Figure 1Y

| Designation | Sequence | SEQ ID NO |
|---|---|---|
| Z11828 | VDAKYAKEEARAWWEIHLLPNLTIRQMTAFISKLFDDPSQSSELLSEAKKLNDSQAPK | 793 |
| Z11829 | VDAKYAKEEAEAWHEIHVLPNLTVSQMAAFISKLFDDPSQSSELLSEAKKLNDSQAPK | 794 |
| Z11830 | VDAKYAKEERQAWREIHILPNLTTDQMSAFISKLFDDPSQSSELLSEAKKLNDSQAPK | 795 |
| Z11831 | VDAKYAKEEATAWREIHLLPNLTVDQMAAFISKLFDDPSQSSELLSEAKKLNDSQAPK | 796 |
| Z11832 | VDAKYAKEERQAWWEIHLLPNLTVTQMAAFISKLFDDPSQSSELLSEAKKLNDSQAPK | 797 |
| Z11834 | VDAKYAKEEARAWREIHLLPNLTISQMAAFISKLFDDPSQSSELLSEAKKLNDSQAPK | 798 |
| Z11837 | VDAKYAKEEAEAWHEIHVLPNLTVEQMAAFISKLFDDPSQSSELLSEAKKLNDSQAPK | 799 |
| Z11838 | VDAKYAKEEAAAWLEIHLLPNLTIDQMAAFISKLFDDPSQSSELLSEAKKLNDSQAPK | 800 |
| Z11839 | VDAKYAKEERDAWYEIHLLPNLTVQQMSAFISKLFDDPSQSSELLSEAKKLNDSQAPK | 801 |
| Z11840 | VDAKYAKEERAAWFEIHTLPNLTVHQMAAFISKLFDDPSQSSELLSEAKKLNDSQAPK | 802 |
| Z11841 | VDAKYAKEEQSAWHEIHTLPNLTVNQMAAFIIKLFDDPSQSSELLSEAKKLNDSQAPK | 803 |
| Z11842 | VDAKYAKEERSAWFEIHILPNLTVRQMAAFIQKLFDDPSQSSELLSEAKKLNDSQAPK | 804 |
| Z11843 | VDAKYAKEEAQAWHEIHVLPNLTVNQMAAFISKLFDDPSQSSELLSEAKKLNDSQAPK | 805 |
| Z11844 | VDAKYAKEEAHAWREIHLLPNLTVSQMAAFISKLFDDPSQSSELLSEAKKLNDSQAPK | 806 |
| Z11845 | VDAKYAKEEARAWREIHLLPNLTVQQMAAFIQKLFDDPSQSSELLSEAKKLNDSQAPK | 807 |
| Z11846 | VDAKYAKEERQAWYEIHMLPNLTITQLEAFISKLFDDPSQSSELLSEAKKLNDSQAPK | 808 |
| Z11847 | VDAKYAKEEREAWYEIHVLPNLTHHQMEAFIQKLFDDPSQSSELLSEAKKLNDSQAPK | 809 |
| Z11848 | VDAKYAKEERRAWFEIHLLPNLTVTQISAFISKLFDDPSQSSELLSEAKKLNDSQAPK | 810 |
| Z11849 | VDAKYAKEEREAWFEIHALPNLTVDQMSAFIIKLYDDPSQSSELLSEAKKLNDSQAPK | 811 |
| Z11850 | VDAKYAKEEAAAWREIHTLPNLTAEQMVEQMAAFISKLFDDPSQSSELLSEAKKLNDSQAPK | 812 |
| Z11851 | VDAKYAKEEREAWHEIHTLPNLTVPNLTVDQMAAFISKLFDDPSQSSELLSEAKKLNDSQAPK | 813 |
| Z11852 | VDAKYAKEEAQAWHEIHILPNLTVHQRAAFISKLFDDPSQSSELLSEAKKLNDSQAPK | 814 |
| Z11853 | VDAKYAKEEQHAWYEIHILPNLTVTQMAAFIQKLFDDPSQSSELLSEAKKLNDSQAPK | 815 |
| Z11854 | VDAKYAKEEHHAWYEIHTLPNLTIQQMAAFISKLFDDPSQSSELLSEAKKLNDSQAPK | 816 |
| Z11855 | VDAKYAKEEAHAWYEIHTLPNLTVNQMAAFISKLFDDPSQSSELLSEAKKLNDSQAPK | 817 |
| Z11856 | VDAKYAKEEAAAWREIHTLPNLTAEQMAAFISKLFDDPSQSSELLSEAKKLNDSQAPK | 818 |
| Z11857 | VDAKYAKEEASAWYETHLLPNLTVEQMAAFIKLYDDPSQSSELLSEAKKLNDSQAPK | 819 |
| Z11858 | VDAKYAKEERKAWYEIHVLPNLTVDQMAAFISKLFDDPSQSSELLSEAKKLNDSQAPK | 820 |
| Z11859 | VDAKYAKEEAHAWHEIHILPNLTVNQIAAFISKLFDDPSQSSELLSEAKKLNDSQAPK | 821 |
| Z11863 | VDAKYAKEERRAWAEIHKLPNLTISQIAAFISKLFDDPSQSSELLSEAKKLNDSQAPK | 822 |
| Z11864 | VDAKYAKEEAHAWLEIHALPNLTIEQISAFIIKLYDDPSQSSELLSEAKKLNDSQAPK | 823 |
| Z11867 | VDAKYAKEERTAWYEIHLLPNLTIQQMAAFISKLFDDPSQSSELLSEAKKLNDSQAPK | 824 |
| Z11868 | VDAKYAKEERHAWYEIHLLPNLTVTQMAAFISKLFDDPSQSSELLSEAKKLNDSQAPK | 825 |

Figure 1Z

| Designation | Sequence | SEQ ID NO |
|---|---|---|
| Z11869 | VDAKYAKEERRAWYEIHLLPNLTVEQIAAFISKLFDDPSQSSELLSEAKKLNDSQAPK | 826 |
| Z11870 | VDAKYAKEERDAWFEIHALPNLTVTQVAAFISKLFDDPSQSSELLSEAKKLNDSQAPK | 827 |
| Z11873 | VDAKYAKEEQEAWTEIHTLPNLTTIDQMTAFIIKLFDDPSQSSELLSEAKKLNDSQAPK | 828 |
| Z11876 | VDAKYAKEEREAWWEIHALPNLTTNQIAAFISKLFDDPSQSSELLSEAKKLNDSQAPK | 829 |
| Z11877 | VDAKYAKEERAAWYEIHLLPNLTVTQIAAFISKLFDDPSQSSELLSEAKKLNDSQAPK | 830 |
| Z11878 | VDAKYAKEEAKAWYEIHIHLPNLTVTQIAAFISKLFDDPSQSSELLSEAKKLNDSQAPK | 831 |
| Z11879 | VDAKYAKEEREAWHEIHILPNLTVNQMAAFISKLFDDPSQSSELLSEAKKLNDSQAPK | 832 |
| Z11880 | VDAKYAKEERAAWREIHLLPNLTVSQMEAFISKLFDDPSQSSELLSEAKKLNDSQAPK | 833 |
| Z11884 | VDAKYAKEERTAWFEIHTLPNLTVQQMAAFIIKLFDDPSQSSELLSEAKKLNDSQAPK | 834 |
| Z11885 | VDAKYAKEEREAWHEIHILPNLTIEQMAAFIQKLFDDPSQSSELLSEAKKLNDSQAPK | 835 |
| Z11886 | VDAKYAKEERQAWYEIHILPNLTVRQISAFISKLFDDPSQSSELLSEAKKLNDSQAPK | 836 |
| Z11887 | VDAKYAKEEAQAWTEIHILPNLTVSQMAAFIQKLFDDPSQSSELLSEAKKLNDSQAPK | 837 |
| Z11888 | VDAKYAKEEHDAWYEIHTLPNLTVDQVSAFISKLFDDPSQSSELLSEAKKLNDSQAPK | 838 |
| Z11889 | VDAKYAKEEAEAWREIHLLPNLTINQIAAFISKLFDDPSQSSELLSEAKKLNDSQAPK | 839 |
| Z11891 | VDAKYAKEEQSAWTEIHTLPNLTTDQRVAFISKLFDDPSQSSELLSEAKKLNDSQAPK | 840 |
| Z11894 | VDAKYAKEERDAWHEIHLLPNLTIEQRAAFISKLFDDPSQSSELLSEAKKLNDSQAPK | 841 |
| Z11898 | VDAKYAKEEARAWHEIHVLPNLTTDQRVAFISKLFDDPSQSSELLSEAKKLNDSQAPK | 842 |
| Z11899 | VDAKYAKEEADAWFEIHMLPNLTIDQMTAFIMKLFDDPSQSSELLSEAKKLNDSQAPK | 843 |
| Z11900 | VDAKYAKEEAEAWWEIHALPNLTVSQTAAFISKLFDDPSQSSELLSEAKKLNDSQAPK | 844 |
| Z11902 | VDAKYAKEERDAWFEIHALPNLTISQMTAFIISKLFDDPSQSSELLSEAKKLNDSQAPK | 845 |
| Z11908 | VDAKYAKEERRAWYEIHTLPNLTVSQMAAFISKLFDDPSQSSELLSEAKKLNDSQAPK | 846 |
| Z11909 | VDAKYAKEEREAWYEIHLLPNLTTRQMAAFIIKLFDDPSQSSELLSEAKKLNDSQAPK | 847 |
| Z11910 | VDAKYAKEEHDAWYEIHVLPNLTVNQIAAFISKLFDDPSQSSELLSEAKKLNDSQAPK | 848 |
| Z11911 | VDAKYAKEEAHAWAEIHSLPNLTVDQMVAFISKLFDDPSQSSELLSEAKKLNDSQAPK | 849 |
| Z11913 | VDAKYAKEEREAWWEIHTLPNLTVTQMAAFIQKLFDDPSQSSELLSEAKKLNDSQAPK | 850 |
| Z11914 | VDAKYAKEERVAWYEIHLLPNLTIDQMAAFISKLFDDPSQSSELLSEAKKLNDSQAPK | 851 |
| Z11915 | VDAKYAKEEARAWHEIHLLPNLTVSQITAFISKLFDDPSQSSELLSEAKKLNDSQAPK | 852 |
| Z11916 | VDAKYAKEEADAWREIHLLPNLTASQMAAFISKLFDDPSQSSELLSEAKKLNDSQAPK | 853 |
| Z11917 | VDAKYAKEEREAWTEIHSLPNLTVDQMAAFIIKLYDDPSQSSELLSEAKKLNDSQAPK | 854 |
| Z11919 | VDAKYAKEERRAWYEIHILPNLTVDQMAAFIIKLFDDPSQSSELLSEAKKLNDSQAPK | 855 |
| Z11920 | VDAKYAKEEREAWYEIHILPNLTIEQMAAFISKLFDDPSQSSELLSEAKKLNDSQAPK | 856 |
| Z11921 | VDAKYAKEEARAWHEIHILPNLTIDQMAAFISKLFDDPSQSSELLSEAKKLNDSQAPK | 857 |
| Z11924 | VDAKYAKEERQAWHEIHTLPNLTTDQMAAFISKLFDDPSQSSELLSEAKKLNDSQAPK | 858 |

Figure 1AA

| Designation | Sequence | SEQ ID NO |
|---|---|---|
| Z11925 | VDAKYAKEEHDAWWEIHKLPNLTVNQTAAFISKLFDDPSQSSELLSEAKKLNDSQAPK | 859 |
| Z11926 | VDAKYAKEERTAWHEIHSLPNLTIDQMAAFIIKLFDDPSQSSELLSEAKKLNDSQAPK | 860 |
| Z11927 | VDAKYAKEERAAWWEIHLLPNLTTTQMAAFIHKLFDDPSQSSELLSEAKKLNDSQAPK | 861 |
| Z11928 | VDAKYAKEERDAWREIHLLPNLTIDQMAAFISKLFDDPSQSSELLSEAKKLNDSQAPK | 862 |
| Z11930 | VDAKYAKEEQVAWHEIHLLPNLTIDQMTAFIHKLFDDPSQSSELLSEAKKLNDSQAPK | 863 |
| Z11931 | VDAKYAKEEAQAWREIHLLPNLTVDQMAAFISKLFDDPSQSSELLSEAKKLNDSQAPK | 864 |
| Z11932 | VDAKYAKEEAKAWFEIHILPNLTVQQVAAFISKLFDDPSQSSELLSEAKKLNDSQAPK | 865 |
| Z11934 | VDAKYAKEEHAAWREITLLPNLTINQRAAFISKLFDDPSQSSELLSEAKKLNDSQAPK | 866 |
| Z11935 | VDAKYAKEEAEAWSEIHKLPNLTVTQMAAFITKLFDDPSQSSELLSEAKKLNDSQAPK | 867 |
| Z11936 | VDAKYAKEEQQAWYEIHLLPNLTVTQMSAFIHKLFDDPSQSSELLSEAKKLNDSQAPK | 868 |
| Z11938 | VDAKYAKEEARAWYEIHLLPNLTIEQMAAFISKLFDDPSQSSELLSEAKKLNDSQAPK | 869 |
| Z11940 | VDAKYAKEEAEAWTEIHLLPNLTVEQRVAFISKLFDDPSQSSELLSEAKKLNDSQAPK | 870 |
| Z11941 | VDAKYAKEERQAWTEIHLLPNLTVEQMAAFIQKLFDDPSQSSELLSEAKKLNDSQAPK | 871 |
| Z14455 | VDAKYAKEEYYAWTEIHKLPNLTIDQMAAFITKLFDDPSQSSELLSEAKKLNDSQAPK | 872 |
| Z14456 | VDAKYAKEEQAAWMEIHLLPNLTIDQMAAFITKLFDDPSQSSELLSEAKKLNDSQAPK | 873 |
| Z14457 | VDAKYAKEEYAAWTEIHLLPNLTIDQMAAFITKLFDDPSQSSELLSEAKKLNDSQAPK | 874 |
| Z14458 | VDAKYAKEEKEAWYEIHILPNLTISQMAAFITKLFDDPSQSSELLSEAKKLNDSQAPK | 875 |
| Z14459 | VDAKYAKEEREAWYEIHKLPNLTIVQMAAFITKLFDDPSQSSELLSEAKKLNDSQAPK | 876 |
| Z14460 | VDAKYAKEEYEAWVEIHKLPNLTVDQMAAFITKLFDDPSQSSELLSEAKKLNDSQAPK | 877 |
| Z14461 | VDAKYAKEEAYAWKEIHKLPNLTIEQMAAFITKLFDDPSQSSELLSEAKKLNDSQAPK | 878 |
| Z14462 | VDAKYAKEEKAAWTEIHLLPNLTIFQMAAFITKLFDDPSQSSELLSEAKKLNDSQAPK | 879 |
| Z14463 | VDAKYAKEEKEAWYEIHLLPNLTIHLPNLTITTQMAAFITKLFDDPSQSSELLSEAKKLNDSQAPK | 880 |
| Z14464 | VDAKYAKEERKAWYEIHLLPNLTVTQMAAFITKLFDDPSQSSELLSEAKKLNDSQAPK | 881 |
| Z14465 | VDAKYAKEEAMAWREIHLLPNLTVNQIAAFITKLFDDPSQSSELLSEAKKLNDSQAPK | 882 |
| Z14466 | VDAKYAKEEKHAWNEIHKLPNLTVEQMAAFITKLFDDPSQSSELLSEAKKLNDSQAPK | 883 |
| Z14467 | VDAKYAKEEYEAWTEIHLLPNLTIDQMAAFITKLFDDPSQSSELLSEAKKLNDSQAPK | 884 |
| Z14468 | VDAKYAKEEWNAWTEIHNLPNLTIDQMAAFITKLFDDPSQSSELLSEAKKLNDSQAPK | 885 |
| Z14469 | VDAKYAKEERAAWTEIHGLPNLTVEQMAAFITKLFDDPSQSSELLSEAKKLNDSQAPK | 886 |
| Z14470 | VDAKYAKEEADAWLEIHNLPNLTISQMAAFITKLFDDPSQSSELLSEAKKLNDSQAPK | 887 |
| Z14471 | VDAKYAKEEKAAWHEIHILPNLTVYQIAAFITKLFDDPSQSSELLSEAKKLNDSQAPK | 888 |
| Z14472 | VDAKYAKEEKAWWEIHILPNLTIEQMAAFITKLFDDPSQSSELLSEAKKLNDSQAPK | 889 |
| Z14473 | VDAKYAKEEKSAWMEIHLLPNLTIEQMAAFITKLFDDPSQSSELLSEAKKLNDSQAPK | 890 |
| Z14474 | VDAKYAKEEYAAWMEIHRLPNLTIEQIAAFITKLFDDPSQSSELLSEAKKLNDSQAPK | 891 |

Figure 1BB

| Designation | Sequence | SEQ ID NO |
|---|---|---|
| Z14475 | VDAKYAKEEFRAWIEIHTLPNLTVDQMAAFITKLFDDPSQSELLSEAKKLNDSQAPK | 892 |
| Z14476 | VDAKYAKEEKDAWNEIHKLPNLTIEQIAAFITKLFDDPSQSELLSEAKKLNDSQAPK | 893 |
| Z14477 | VDAKYAKEEHAWYEIHLLPNLTVEQMAAFITKLFDDPSQSELLSEAKKLNDSQAPK | 894 |
| Z14478 | VDAKYAKEEYEAWLEIHLLPNLTVDQMAAFISKLFDDPSQSSELLSEAKKLNDSQAPK | 895 |
| Z14479 | VDAKYAKEEKNAWHEIHRLPNLTVNQMAAFITKLFDDPSQSSELLSEAKKLNDSQAPK | 896 |
| Z14480 | VDAKYAKEEKNAWTEIHNLPNLTISQMAAFITKLFDDPSQSSELLSEAKKLNDSQAPK | 897 |
| Z14481 | VDAKYAKEEAAAWYEIHALPNLTVEQMAAFITKLFDDPSQSSELLSEAKKLNDSQAPK | 898 |
| Z14482 | VDAKYAKEEWNAWMEIHLLPNLTVTQMAAFITKLFDDPSQSSELLSEAKKLNDSQAPK | 899 |
| Z14483 | VDAKYAKEEAKAWHEIHILPNLTVHQIAAFITKLFDDPSQSSELLSEAKKLNDSQAPK | 900 |
| Z14484 | VDAKYAKEERKAWHEIHILPNLTVHQIAAFITKLFDDPSQSSELLSEAKKLNDSQAPK | 901 |
| Z14485 | VDAKYAKEESKAWFEIHALPNLTVEQIAAFITKLFDDPSQSSELLSEAKKLNDSQAPK | 902 |
| Z14486 | VDAKYAKEEKRAWYEIHILPNLTISQIAAFISKLFDDPSQSSELLSEAKKLNDSQAPK | 903 |
| Z14487 | VDAKYAKEEKKAWTEIHVLPNLTISQIAAFISKLFDDPSQSSELLSEAKKLNDSQAPK | 904 |
| Z14488 | VDAKYAKEERDAWFEIHALPNLTITDQMAAFITKLFDDPSQSSELLSEAKKLNDSQAPK | 905 |
| Z14489 | VDAKYAKEEYEAWEEIHRLPNLTIDQMAAFISKLFDDPSQSSELLSEAKKLNDSQAPK | 906 |
| Z14490 | VDAKYAKEERNAWFEIHKLPNLTINQMAAFITKLFDDPSQSSELLSEAKKLNDSQAPK | 907 |
| Z14491 | VDAKYAKEEHHAWNEIHKLPNLTVDQIAAFITKLFDDPSQSSELLSEAKKLNDSQAPK | 908 |
| Z14492 | VDAKYAKEEHYAWKEIHLLPNLTIDQMAAFITKLFDDPSQSSELLSEAKKLNDSQAPK | 909 |
| Z14493 | VDAKYAKEESDAWYEIHLLPNLTIEQMAAFITKLFDDPSQSSELLSEAKKLNDSQAPK | 910 |
| Z14494 | VDAKYAKEEYEAWMEIHLLPNLTIDQMAAFITKLFDDPSQSSELLSEAKKLNDSQAPK | 911 |
| Z14495 | VDAKYAKEEKEAWYEIHLLPNLTVEQMAAFISKLFDDPSQSSELLSEAKKLNDSQAPK | 912 |
| Z14496 | VDAKYAKEERAAWKEIHILPNLTVEQIAAFITKLFDDPSQSSELLSEAKKLNDSQAPK | 913 |
| Z14497 | VDAKYAKEEKEAWYEIHILPNLTVHQVAAFITKLFDDPSQSSELLSEAKKLNDSQAPK | 914 |
| Z14498 | VDAKYAKEEYDAWIEIHALPNLTVDQMAAFITKLFDDPSQSSELLSEAKKLNDSQAPK | 915 |
| Z14499 | VDAKYAKEERKAWTEIHLLPNLTIDQMAAFISKLFDDPSQSSELLSEAKKLNDSQAPK | 916 |
| Z14500 | VDAKYAKEEYHAWVEIHNLPNLTIDQIAAFISKLFDDPSQSSELLSEAKKLNDSQAPK | 917 |
| Z14501 | VDAKYAKEEREAWTEIHLLPNLTIDQMAAFITKLFDDPSQSSELLSEAKKLNDSQAPK | 918 |
| Z14502 | VDAKYAKEEQWAWYEIHLLPNLTVHQVAAFITKLFDDPSQSSELLSEAKKLNDSQAPK | 919 |
| Z14503 | VDAKYAKEEKQAWMEIHKLPNLTVHQVAAFISKLFDDPSQSSELLSEAKKLNDSQAPK | 920 |
| Z14504 | VDAKYAKEESDAWTEIHKLPNLTIDQMAAFITKLFDDPSQSSELLSEAKKLNDSQAPK | 921 |
| Z14505 | VDAKYAKEEAQAWWEITSLPNLTVDQIAAFITKLFDDPSQSSELLSEAKKLNDSQAPK | 922 |
| Z14506 | VDAKYAKEEKMAWYIHNLPNLTVNQMAAFITKLFDDPSQSSELLSEAKKLNDSQAPK | 923 |
| Z14507 | VDAKYAKEEWMAWMEIHNLPNLTVNQMAAFITKLFDDPSQSSELLSEAKKLNDSQAPK | 924 |

Figure 1CC

| Designation | Sequence | SEQ ID NO |
|---|---|---|
| Z14508 | VDAKYAKEEARAWYEIHILPNLTVKQMAAFITKLFDDPSQSSELLSEAKKLNDSQAPK | 925 |
| Z14509 | VDAKYAKEEAKAWHEIHILPNLTVSQVAAFITKLFDDPSQSSELLSEAKKLNDSQAPK | 926 |
| Z14510 | VDAKYAKEERAAWHEIHILPNLTVDQMAAFISKLFDDPSQSSELLSEAKKLNDSQAPK | 927 |
| Z14511 | VDAKYAKEEWQAWTEIHLLPNLTLDQVAAFITKLFDDPSQSSELLSEAKKLNDSQAPK | 928 |
| Z14512 | VDAKYAKEEAFAWEEIHRLPNLTIEQMAAFITKLFDDPSQSSELLSEAKKLNDSQAPK | 929 |
| Z14513 | VDAKYAKEERKAWYEIHKLPNLTVDQMAAFITKLFDDPSQSSELLSEAKKLNDSQAPK | 930 |
| Z14514 | VDAKYAKEERKQAWYEIHILPNLTVEQMAAFITKLFDDPSQSSELLSEAKKLNDSQAPK | 931 |
| Z14515 | VDAKYAKEEYDAWWEIHLLPNLTVDQMAAFITKLFDDPSQSSELLSEAKKLNDSQAPK | 932 |
| Z14516 | VDAKYAKEEHDAWNEIHLLPNLTIDQMAAFITKLFDDPSQSSELLSEAKKLNDSQAPK | 933 |
| Z14517 | VDAKYAKEEYTAWTEIHQLPNLTVQQMAAFITKLFDDPSQSSELLSEAKKLNDSQAPK | 934 |
| Z14518 | VDAKYAKEEARAWHEIHLLPNLTVRQIAAFITKLFDDPSQSSELLSEAKKLNDSQAPK | 935 |
| Z14519 | VDAKYAKEERNAWFEIHQLPNLTVHQVAAFITKLFDDPSQSSELLSEAKKLNDSQAPK | 936 |
| Z14520 | VDAKYAKEEADAWYEIHLLPNLTVEQIAAFITKLFDDPSQSSELLSEAKKLNDSQAPK | 937 |
| Z14522 | VDAKYAKEEFAWKEIHILPNLTVDQMAAFITKLFDDPSQSSELLSEAKKLNDSQAPK | 938 |
| Z14523 | VDAKYAKEEAYAWWEIHKLPNLTVHQMAAFITKLFDDPSQSSELLSEAKKLNDSQAPK | 939 |
| Z14526 | VDAKYAKEEKTAWHEIHNLPNLTIDQMAAFITKLFDDPSQSSELLSEAKKLNDSQAPK | 940 |
| Z14527 | VDAKYAKEEAKAWNEIHKLPNLTIDQIAAFITKLFDDPSQSSELLSEAKKLNDSQAPK | 941 |
| Z14528 | VDAKYAKEEKDAWIEIHNLPNLTVEQMAAFISKLFDDPSQSSELLSEAKKLNDSQAPK | 942 |
| Z14529 | VDAKYAKEEFFAWKEIHLLPNLTVEQIAAFITKLFDDPSQSSELLSEAKKLNDSQAPK | 943 |
| Z14530 | VDAKYAKEEQAAWLEIHLLPNLTVSQIAAFITKLFDDPSQSSELLSEAKKLNDSQAPK | 944 |
| Z14531 | VDAKYAKEEYFAWREIHVLPNLTVDQMAAFISKLFDDPSQSSELLSEAKKLNDSQAPK | 945 |
| Z14532 | VDAKYAKEEYYAWREIHLLPNLTITQMAAFITKLFDDPSQSSELLSEAKKLNDSQAPK | 946 |
| Z14533 | VDAKYAKEEKMAWTEIHLLPNLTISQMAAFITKLFDDPSQSSELLSEAKKLNDSQAPK | 947 |
| Z14534 | VDAKYAKEERNAWFEIHVLPNLTVKQMAAFITKLFDDPSQSSELLSEAKKLNDSQAPK | 948 |
| Z14535 | VDAKYAKEEKRAWTEIHILPNLTVEQMAAFISKLFDDPSQSSELLSEAKKLNDSQAPK | 949 |
| Z14536 | VDAKYAKEEAAAWKEIHLLPNLTHALPNLTVEQIAAFITKLFDDPSQSSELLSEAKKLNDSQAPK | 950 |
| Z14537 | VDAKYAKEEKEAWMEIHALPNLTHALPNLTVEQIAAFITKLFDDPSQSSELLSEAKKLNDSQAPK | 951 |
| Z14539 | VDAKYAKEEKEAWYEIHNLPNLTIIQMAAFITKLFDDPSQSSELLSEAKKLNDSQAPK | 952 |
| Z14540 | VDAKYAKEEYDAWFEIHILPNLTVHQIAAFITKLFDDPSQSSELLSEAKKLNDSQAPK | 953 |
| Z14541 | VDAKYAKEEYGAWNEIHKLPNLTIDQMAAFITKLFDDPSQSSELLSEAKKLNDSQAPK | 954 |
| Z14542 | VDAKYAKEEWQAWMEIHSLPNLTVDQMAAFIVEQMAAFITKLFDDPSQSSELLSEAKKLNDSQAPK | 955 |
| Z14543 | VDAKYAKEEWNAWFEIHKLPNLTVEQMAAFITKLFDDPSQSSELLSEAKKLNDSQAPK | 956 |
| Z14544 | VDAKYAKEEANAWKEIHLLPNLTVDQMAAFITKLFDDPSQSSELLSEAKKLNDSQAPK | 957 |

Figure 1DD

| Designation | Sequence | SEQ ID NO |
|---|---|---|
| Z14545 | VDAKYAKEEYEAWTEIHLLPNLTVHQMAAFITKLFDDPSQSSELLSEAKKLNDSQAPK | 958 |
| Z14546 | VDAKYAKEERIAWWEIHSLPNLTVNQVAAFISKLFDDPSQSSELLSEAKKLNDSQAPK | 959 |
| Z14548 | VDAKYAKEEYNAWVEIHTLPNLTVNQMAAFITKLFDDPSQSSELLSEAKKLNDSQAPK | 960 |
| Z14549 | VDAKYAKEEAFAWSEIHILPNLTIDQIAAFITKLFDDPSQSSELLSEAKKLNDSQAPK | 961 |
| Z14552 | VDAKYAKEEAHAWHEIHILPNLTIDQIAAFISKLFDDPSQSSELLSEAKKLNDSQAPK | 962 |
| Z14553 | VDAKYAKEEAAAWNEIHRLPNLTVDQIAAFISKLFDDPSQSSELLSEAKKLNDSQAPK | 963 |
| Z14554 | VDAKYAKEEKAAWTEIHLLPNLTVDQMAAFITKLFDDPSQSSELLSEAKKLNDSQAPK | 964 |
| Z14555 | VDAKYAKEEKGAWNEIHLLPNLTIQQMAAFISKLFDDPSQSSELLSEAKKLNDSQAPK | 965 |
| Z14557 | VDAKYAKEEYAAWMEIHSLPNLTVDQMAAFISKLFDDPSQSSELLSEAKKLNDSQAPK | 966 |
| Z14558 | VDAKYAKEEAAAWKEIHLLPNLTIEQIAAFITKLFDDPSQSSELLSEAKKLNDSQAPK | 967 |
| Z14560 | VDAKYAKEEKFAWNEIHILPNLTVHQIAAFITKLFDDPSQSSELLSEAKKLNDSQAPK | 968 |
| Z14561 | VDAKYAKEEYNAWLEIHILPNLTINQMAAFITKLFDDPSQSSELLSEAKKLNDSQAPK | 969 |
| Z14562 | VDAKYAKEEHTAWLEIHSLPNLTIEQVAAFITKLFDDPSQSSELLSEAKKLNDSQAPK | 970 |
| Z14563 | VDAKYAKEEKDAWMEIHILPNLTVDQMAAFITKLFDDPSQSSELLSEAKKLNDSQAPK | 971 |
| Z14564 | VDAKYAKEEATAWIEIHSLPNLTVDQMAAFITKLFDDPSQSSELLSEAKKLNDSQAPK | 972 |
| Z14565 | VDAKYAKEEKEAWWEIHLLPNLTVDQMAAFITKLFDDPSQSSELLSEAKKLNDSQAPK | 973 |
| Z14566 | VDAKYAKEEQHAWIEIHKLPNLTVDQMAAFITKLFDDPSQSSELLSEAKKLNDSQAPK | 974 |
| Z14567 | VDAKYAKEEKHAWHEIHILPNLTIEQMAAFITKLFDDPSQSSELLSEAKKLNDSQAPK | 975 |
| Z14568 | VDAKYAKEEAKAWHEIHALPNLTIEQMAAFITKLFDDPSQSSELLSEAKKLNDSQAPK | 976 |
| Z14569 | VDAKYAKEEKKAWTEIHILPNLTVEQIAAFITKLFDDPSQSSELLSEAKKLNDSQAPK | 977 |
| Z14570 | VDAKYAKEERAAWYEIHVLPNLTVSQMAAFITKLFDDPSQSSELLSEAKKLNDSQAPK | 978 |
| Z14571 | VDAKYAKEERFAWAEIHKLPNLTIDQMAAFITKLFDDPSQSSELLSEAKKLNDSQAPK | 979 |
| Z14572 | VDAKYAKEEYAAWFEIHLLPNLTIDQMAAFISKLFDDPSQSSELLSEAKKLNDSQAPK | 980 |
| Z14573 | VDAKYAKEEYDAWFEIHLLPNLTVDQMAAFITKLFDDPSQSSELLSEAKKLNDSQAPK | 981 |
| Z14574 | VDAKYAKEEWEAWMEIHALPNLTVDQMAAFITKLFDDPSQSSELLSEAKKLNDSQAPK | 982 |
| Z14575 | VDAKYAKEEKDAWNEIHALPNLTIEQMAAFITKLFDDPSQSSELLSEAKKLNDSQAPK | 983 |
| Z14576 | VDAKYAKEERDAWFEIHSLPNLTVDQIAAFITKLFDDPSQSSELLSEAKKLNDSQAPK | 984 |
| Z14577 | VDAKYAKEEFYAWLEIHILPNLTVSQMAAFITKLFDDPSQSSELLSEAKKLNDSQAPK | 985 |
| Z14578 | VDAKYAKEEYAAWYEIHILPNLTVDQMAAFITKLFDDPSQSSELLSEAKKLNDSQAPK | 986 |
| Z14579 | VDAKYAKEERDAWFEIHLLPNLTVNQMAAFITKLFDDPSQSSELLSEAKKLNDSQAPK | 987 |
| Z14580 | VDAKYAKEEYRAWTEIHILPNLTITQIAAFITKLFDDPSQSSELLSEAKKLNDSQAPK | 988 |
| Z14581 | VDAKYAKEEYAWTEIHLLPNLTIEQMAAFISKLFDDPSQSSELLSEAKKLNDSQAPK | 989 |
| Z14582 | VDAKYAKEEDAWLEIHILPNLTVEQIAAFITKLFDDPSQSSELLSEAKKLNDSQAPK | 990 |

Figure 1EE

| Designation | Sequence | SEQ ID NO |
|---|---|---|
| Z14583 | VDAKYAKEERKAWYEIHSLPNLTVDQMAAFITKLFDDPSQSSELLSEAKKLNDSQAPK | 991 |
| Z14584 | VDAKYAKEEHTAWTEIHRLPNLTIEQMAAFITKLFDDPSQSSELLSEAKKLNDSQAPK | 992 |
| Z14585 | VDAKYAKEEYQAWTEIHLLPNLTVEQMAAFITKLFDDPSQSSELLSEAKKLNDSQAPK | 993 |
| Z14586 | VDAKYAKEERMAWFEIHSLPNLTVDQMAAFITKLFDDPSQSSELLSEAKKLNDSQAPK | 994 |
| Z14587 | VDAKYAKEEYDAWYEIHILPNLTVEQIAAFITKLFDDPSQSSELLSEAKKLNDSQAPK | 995 |
| Z14588 | VDAKYAKEEKEAWMEIHLLPNLTIDQMAAFITKLFDDPSQSSELLSEAKKLNDSQAPK | 996 |
| Z14589 | VDAKYAKEEYDAWFEIHSLPNLTVNQMAAFITKLFDDPSQSSELLSEAKKLNDSQAPK | 997 |
| Z14590 | VDAKYAKEEAFAWREIHILPNLTIDQMAAFITKLFDDPSQSSELLSEAKKLNDSQAPK | 998 |
| Z14591 | VDAKYAKEERKAWMEIHLLPNLTIEQMAAFITKLFDDPSQSSELLSEAKKLNDSQAPK | 999 |
| Z14592 | VDAKYAKEEKAAWIEIHNLPNLTVDQMAAFITKLFDDPSQSSELLSEAKKLNDSQAPK | 1000 |
| Z14593 | VDAKYAKEERNAWIEIHNLPNLTIEQMAAFITKLFDDPSQSSELLSEAKKLNDSQAPK | 1001 |
| Z14594 | VDAKYAKEEKNAWTEIHLLPNLTVHQIAAFITKLFDDPSQSSELLSEAKKLNDSQAPK | 1002 |
| Z14595 | VDAKYAKEEAEAWWEIHILPNLTVSQMAAFITKLFDDPSQSSELLSEAKKLNDSQAPK | 1003 |
| Z14597 | VDAKYAKEEKEAWFEIHTLPNLTVDQVAAFITKLFDDPSQSSELLSEAKKLNDSQAPK | 1004 |
| Z14598 | VDAKYAKEEYEAWYEIHILPNLTIHQMAAFISKLFDDPSQSSELLSEAKKLNDSQAPK | 1005 |
| Z14599 | VDAKYAKEEARAWKEIHLLPNLTVGQIAAFITKLFDDPSQSSELLSEAKKLNDSQAPK | 1006 |
| Z14600 | VDAKYAKEEKQAWMEIHLLPNLTVDQMAAFITKLFDDPSQSSELLSEAKKLNDSQAPK | 1007 |
| Z14601 | VDAKYAKEEAAAWMEIHILPNLTVHQIAAFITKLFDDPSQSSELLSEAKKLNDSQAPK | 1008 |
| Z14602 | VDAKYAKEEKEAWFEIHLLPNLTVSQMAAFITKLFDDPSQSSELLSEAKKLNDSQAPK | 1009 |
| Z14603 | VDAKYAKEEKEAWFEIHTLPNLTIHQVAAFITKLFDDPSQSSELLSEAKKLNDSQAPK | 1010 |
| Z14604 | VDAKYAKEEAWFEIHTLPNLTVDQVAAFITKLFDDPSQSSELLSEAKKLNDSQAPK | 1011 |
| Z14605 | VDAKYAKEEYLAWVEIHNLPNLTIDQMAAFITKLFDDPSQSSELLSEAKKLNDSQAPK | 1012 |
| Z14606 | VDAKYAKEERDAWYEIHNLPNLTVGQMAAFITKLFDDPSQSSELLSEAKKLNDSQAPK | 1013 |
| Z14607 | VDAKYAKEESAAWFEIHLLPNLTINQMAAFITKLFDDPSQSSELLSEAKKLNDSQAPK | 1014 |
| Z14608 | VDAKYAKEEQYAWTEIHILPNLTVNQIAAFITKLFDDPSQSSELLSEAKKLNDSQAPK | 1015 |
| Z14610 | VDAKYAKEEKRAWMEIHLLPNLTVSQMAAFITKLFDDPSQSSELLSEAKKLNDSQAPK | 1016 |
| Z14611 | VDAKYAKEEKEAWFEIHLLPNLTIHQVAAFISKLFDDPSQSSELLSEAKKLNDSQAPK | 1017 |
| Z14612 | VDAKYAKEEWLAWNEIHLLPNLTISQIAAFITKLFDDPSQSSELLSEAKKLNDSQAPK | 1018 |
| Z14613 | VDAKYAKEEYNAWLEIHILPNLTVHQIAAFISKLFDDPSQSSELLSEAKKLNDSQAPK | 1019 |
| Z14615 | VDAKYAKEEHTAWMEIHRLPNLTIDQIAAFISKLFDDPSQSSELLSEAKKLNDSQAPK | 1020 |
| Z14616 | VDAKYAKEEKFAWTEIHLLPNLTVDQIAAFITKLFDDPSQSSELLSEAKKLNDSQAPK | 1021 |
| Z14617 | VDAKYAKEEKYAWTEIHILPNLTVNQMAAFITKLFDDPSQSSELLSEAKKLNDSQAPK | 1022 |
| Z14618 | VDAKYAKEEKFAWHEIHKLPNLTVDQIAAFITKLFDDPSQSSELLSEAKKLNDSQAPK | 1023 |

Figure 1FF

| Designation | Sequence | SEQ ID NO |
|---|---|---|
| Z14619 | VDAKYAKEERKAWYEIHGLPNLTVEQMAAFITKLFDDPSQSSELLSEAKKLNDSQAPK | 1024 |
| Z14621 | VDAKYAKEEYQAWLEIHLLPNLTVDQIAAFITKLFDDPSQSSELLSEAKKLNDSQAPK | 1025 |
| Z14622 | VDAKYAKEEKHAWMEIHLLPNLTVEQMAAFITKLFDDPSQSSELLSEAKKLNDSQAPK | 1026 |
| Z14623 | VDAKYAKEEKQAWREIHLLPNLTVDQIAAFISKLFDDPSQSSELLSEAKKLNDSQAPK | 1027 |
| Z14624 | VDAKYAKEEAMAWTEIHLLPNLTVSQMAAFITKLFDDPSQSSELLSEAKKLNDSQAPK | 1028 |
| Z14625 | VDAKYAKEEKHAWREIHLLPNLTLNQMAAFITKLFDDPSQSSELLSEAKKLNDSQAPK | 1029 |
| Z14626 | VDAKYAKEERYAWNEIHALPNLTVEQVAAFITKLFDDPSQSSELLSEAKKLNDSQAPK | 1030 |
| Z14627 | VDAKYAKEEREAWWEIHKLPNLTVDQMAAFISKLFDDPSQSSELLSEAKKLNDSQAPK | 1031 |
| Z14628 | VDAKYAKEEHRAWTEIHLLPNLTVDQMAAFITKLFDDPSQSSELLSEAKKLNDSQAPK | 1032 |
| Z14629 | VDAKYAKEEAYAWAEIHKLPNLTVVQMAAFITKLFDDPSQSSELLSEAKKLNDSQAPK | 1033 |
| Z14631 | VDAKYAKEEYFAWTEIHKLPNLTIDQIAAFITKLFDDPSQSSELLSEAKKLNDSQAPK | 1034 |
| Z14632 | VDAKYAKEEAHAWQEIHLLPNLTINQIAAFISKLFDDPSQSSELLSEAKKLNDSQAPK | 1035 |
| Z14633 | VDAKYAKEEKHAWTEIHLLPNLTIDQIAAFITKLFDDPSQSSELLSEAKKLNDSQAPK | 1036 |
| Z14635 | VDAKYAKEEYRAWYEIHILPNLTVKQMAAFITKLFDDPSQSSELLSEAKKLNDSQAPK | 1037 |
| Z14636 | VDAKYAKEEANAWNEIHKLPNLTVDQMAAFITKLFDDPSQSSELLSEAKKLNDSQAPK | 1038 |
| Z14637 | VDAKYAKEEKDAWTEIHKLPNLTIDQMAAFITKLFDDPSQSSELLSEAKKLNDSQAPK | 1039 |
| Z14638 | VDAKYAKEEREAWYEIHNLPNLTIIQMAAFITKLFDDPSQSSELLSEAKKLNDSQAPK | 1040 |
| Z14639 | VDAKYAKEEYYAWNEIHKLPNLTIEQMAAFISKLFDDPSQSSELLSEAKKLNDSQAPK | 1041 |
| Z14640 | VDAKYAKEEKTAWREIHLLPNLTIDQIAAFITKLFDDPSQSSELLSEAKKLNDSQAPK | 1042 |
| Z14641 | VDAKYAKEEAHAWREIHILPNLTLDQMAAFITKLFDDPSQSSELLSEAKKLNDSQAPK | 1043 |
| Z14642 | VDAKYAKEEAAAWLEIHQLPNLTVDQMAAFITKLFDDPSQSSELLSEAKKLNDSQAPK | 1044 |
| Z14643 | VDAKYAKEEAEAWLEIHILPNLTVEQMAAFITKLFDDPSQSSELLSEAKKLNDSQAPK | 1045 |
| Z14644 | VDAKYAKEEANAWFEIHILPNLTVQQMAAFITKLFDDPSQSSELLSEAKKLNDSQAPK | 1046 |
| Z14646 | VDAKYAKEERYAWMEIHLLPNLTINQMAAFITKLFDDPSQSSELLSEAKKLNDSQAPK | 1047 |
| Z14647 | VDAKYAKEERFAWNEIHKLPNLTIDQMAAFISKLFDDPSQSSELLSEAKKLNDSQAPK | 1048 |
| Z14648 | VDAKYAKEEAKANFEIHLLPNLTIDQIAAFISKLFDDPSQSSELLSEAKKLNDSQAPK | 1049 |
| Z14649 | VDAKYAKEEREAWTEIHLLPNLTIEQMAAFITKLFDDPSQSSELLSEAKKLNDSQAPK | 1050 |
| Z14650 | VDAKYAKEEFFAWNEIHKLPNLTIEQMAAFITKLFDDPSQSSELLSEAKKLNDSQAPK | 1051 |
| Z14652 | VDAKYAKEEKAWYEIHILPNLTVHQIAAFITKLFDDPSQSSELLSEAKKLNDSQAPK | 1052 |
| Z14653 | VDAKYAKEEYQAWVEIHNLPNLTVDQMAAFITKLFDDPSQSSELLSEAKKLNDSQAPK | 1053 |
| Z14654 | VDAKYAKEEKKAWREIHLLPNLTINQIAAFITKLFDDPSQSSELLSEAKKLNDSQAPK | 1054 |
| Z14655 | VDAKYAKEEQDAWIEIHLLPNLTVDQMAAFISKLFDDPSQSSELLSEAKKLNDSQAPK | 1055 |
| Z14656 | VDAKYAKEEHDAWWEIHALPNLTINQMAAFISKLFDDPSQSSELLSEAKKLNDSQAPK | 1056 |

Figure 1GG

| Designation | Sequence | SEQ ID NO |
|---|---|---|
| Z14657 | VDAKYAKEEYDAWYEIHLLPNLTIQQMAAFISKLFDDPSQSSELLSEAKKLNDSQAPK | 1057 |
| Z14658 | VDAKYAKEEYQAWVEIHILPNLTIQQIAAFITKLFDDPSQSSELLSEAKKLNDSQAPK | 1058 |
| Z14659 | VDAKYAKEESKAWNEIHKLPNLTTTQMAAFITKLFDDPSQSSELLSEAKKLNDSQAPK | 1059 |
| Z14660 | VDAKYAKEEYQAWYEIHLLPNLTVEQMAAFITKLFDDPSQSSELLSEAKKLNDSQAPK | 1060 |
| Z14661 | VDAKYAKEEKRAWMEIHLLPNLTIGQIAAFITKLFDDPSQSSELLSEAKKLNDSQAPK | 1061 |
| Z14663 | VDAKYAKEERVAWLEIHILPNLTIGQIAAFITKLFDDPSQSSELLSEAKKLNDSQAPK | 1062 |
| Z14664 | VDAKYAKEEQAAWYEIHILPNLTIEQMAAFITKLFDDPSQSSELLSEAKKLNDSQAPK | 1063 |
| Z14665 | VDAKYAKEEKDAWYEIHILPNLTVSQIAAFITKLFDDPSQSSELLSEAKKLNDSQAPK | 1064 |
| Z14666 | VDAKYAKEEKKAWYEIHLLPNLTISQMAAFITKLFDDPSQSSELLSEAKKLNDSQAPK | 1065 |
| Z14667 | VDAKYAKEEKKAWYEIHLLPNLTINQMAAFITKLFDDPSQSSELLSEAKKLNDSQAPK | 1066 |
| Z14668 | VDAKYAKEEHKAWTEIHLLPNLTVDQIAAFITKLFDDPSQSSELLSEAKKLNDSQAPK | 1067 |
| Z14669 | VDAKYAKEEAAAWHEIHLLPNLTIDQMAAFITKLFDDPSQSSELLSEAKKLNDSQAPK | 1068 |
| Z14670 | VDAKYAKEERSAWTEIHLLPNLTITQIAAFITKLFDDPSQSSELLSEAKKLNDSQAPK | 1069 |
| Z14671 | VDAKYAKEERLAWQEIHRLPNLTHLLPNLTVEQMAAFITKLFDDPSQSSELLSEAKKLNDSQAPK | 1070 |
| Z14672 | VDAKYAKEEKDAWTEIHLLPNLTHLLPNLTVEQMAAFITKLFDDPSQSSELLSEAKKLNDSQAPK | 1071 |
| Z14674 | VDAKYAKEEKAAWMEIHNLPNLTHNLPNLTIDQMAAFITKLFDDPSQSSELLSEAKKLNDSQAPK | 1072 |
| Z14675 | VDAKYAKEEYEAWVEIHNLPNLTHNLPNLTIDQMAAFITKLFDDPSQSSELLSEAKKLNDSQAPK | 1073 |
| Z14676 | VDAKYAKEEAKAWTEIHLLPNLTVNQIAAFITKLFDDPSQSSELLSEAKKLNDSQAPK | 1074 |
| Z14677 | VDAKYAKEEKKAWYEIHILPNLTIHQIAAFITKLFDDPSQSSELLSEAKKLNDSQAPK | 1075 |
| Z14678 | VDAKYAKEEKKAWFEIHLLPNLTVDQMAAFITKLFDDPSQSSELLSEAKKLNDSQAPK | 1076 |
| Z14679 | VDAKYAKEERKAWFEIHLLPNLTIDQMAAFISKLFDDPSQSSELLSEAKKLNDSQAPK | 1077 |
| Z14680 | VDAKYAKEERNAWYEIHLLPNLTVDQMAAFITKLFDDPSQSSELLSEAKKLNDSQAPK | 1078 |
| Z14681 | VDAKYAKEEASAWKEIHLLPNLTIDQVAAFITKLFDDPSQSSELLSEAKKLNDSQAPK | 1079 |
| Z14682 | VDAKYAKEEAAAWKEIHLLPNLTIDQMAAFITKLFDDPSQSSELLSEAKKLNDSQAPK | 1080 |
| Z14683 | VDAKYAKEEAWNHEIHILPNLTIEQMAAFISKLFDDPSQSSELLSEAKKLNDSQAPK | 1081 |
| Z14684 | VDAKYAKEEKYAWLEIHILPNLTVDQVAAFITKLFDDPSQSSELLSEAKKLNDSQAPK | 1082 |
| Z14685 | VDAKYAKEERSAWMEIHLLPNLTINQMAAFITKLFDDPSQSSELLSEAKKLNDSQAPK | 1083 |
| Z14686 | VDAKYAKEERMAWNEIHGLPNLTVDQMAAFITKLFDDPSQSSELLSEAKKLNDSQAPK | 1084 |
| Z14687 | VDAKYAKEEAKAWYEIHILPNLTIIQMAAFITKLFDDPSQSSELLSEAKKLNDSQAPK | 1085 |
| Z14688 | VDAKYAKEEKWAWTEIHILPNLTISQMAAFITKLFDDPSQSSELLSEAKKLNDSQAPK | 1086 |
| Z14689 | VDAKYAKEERMAWTEIHNLPNLTIEQMAAFITKLFDDPSQSSELLSEAKKLNDSQAPK | 1087 |
| Z14690 | VDAKYAKEEWAWKEIHILPNLTVEQVAAFITKLFDDPSQSSELLSEAKKLNDSQAPK | 1088 |
| Z14691 | VDAKYAKEEKFAWTEIHKLPNLTVDQMAAFITKLFDDPSQSSELLSEAKKLNDSQAPK | 1089 |

Figure 1HH

| Designation | Sequence | SEQ ID NO |
|---|---|---|
| Z14692 | VDAKYAKEEHYAWQEIHKLPNLTIDQMAAFITKLFDDPSQSSELLSEAKKLNDSQAPK | 1090 |
| Z14693 | VDAKYAKEERKAWYEIHILPNLTITQIAAFITKLFDDPSQSSELLSEAKKLNDSQAPK | 1091 |
| Z14694 | VDAKYAKEERYAWTEIHKLPNLTVDQVAAFISKLFDDPSQSSELLSEAKKLNDSQAPK | 1092 |
| Z14695 | VDAKYAKEEKEAWYEIHILPNLTVSQIAAFITKLFDDPSQSSELLSEAKKLNDSQAPK | 1093 |
| Z14696 | VDAKYAKEEYSAWFEIHILPNLTVEQMAAFITKLFDDPSQSSELLSEAKKLNDSQAPK | 1094 |
| Z14697 | VDAKYAKEERMAWNEIHKLPNLTIDQMAAFISKLFDDPSQSSELLSEAKKLNDSQAPK | 1095 |
| Z14698 | VDAKYAKEEAKAWTEIHLLPNLTVNQVAAFITKLFDDPSQSSELLSEAKKLNDSQAPK | 1096 |
| Z14699 | VDAKYAKEEKFAWREIHLLPNLTIEQMAAFISKLFDDPSQSSELLSEAKKLNDSQAPK | 1097 |
| Z14701 | VDAKYAKEEANAWHEIHLLPNLTIDQMAAFITKLFDDPSQSSELLSEAKKLNDSQAPK | 1098 |
| Z14702 | VDAKYAKEEKHAWNEIHRLPNLTVEQMAAFITKLFDDPSQSSELLSEAKKLNDSQAPK | 1099 |
| Z14703 | VDAKYAKEEHMAWTEIHALPNLTVDQMAAFISKLFDDPSQSSELLSEAKKLNDSQAPK | 1100 |
| Z14704 | VDAKYAKEEYEAWMEIHNLPNLTVDQMAAFITKLFDDPSQSSELLSEAKKLNDSQAPK | 1101 |
| Z14705 | VDAKYAKEERAAWYEIHILPNLTVEQMAAFITKLFDDPSQSSELLSEAKKLNDSQAPK | 1102 |
| Z14707 | VDAKYAKEEKNAWYEIHLLPNLTVVQMAAFITKLFDDPSQSSELLSEAKKLNDSQAPK | 1103 |
| Z14708 | VDAKYAKEEQIAWYEIHILPNLTVDQVAAFITKLFDDPSQSSELLSEAKKLNDSQAPK | 1104 |
| Z14709 | VDAKYAKEEYYAWTEIHRLPNLTVDQMAAFITKLFDDPSQSSELLSEAKKLNDSQAPK | 1105 |
| Z14711 | VDAKYAKEEADAWFEIHILPNLTVDQIAAFITKLFDDPSQSSELLSEAKKLNDSQAPK | 1106 |
| Z14713 | VDAKYAKEEKEAWMEIHKLPNLTVDQMAAFITKLFDDPSQSSELLSEAKKLNDSQAPK | 1107 |
| Z14714 | VDAKYAKEEYLAWIEIHALPNLTVSQMAAFITKLFDDPSQSSELLSEAKKLNDSQAPK | 1108 |
| Z14715 | VDAKYAKEEAFAWNEIHTLPNLTVDQMAAFITKLFDDPSQSSELLSEAKKLNDSQAPK | 1109 |
| Z14716 | VDAKYAKEEYNAWFEIHLLPNLTINQMAAFITKLFDDPSQSSELLSEAKKLNDSQAPK | 1110 |
| Z14717 | VDAKYAKEEAWVEIHLLPNLTVNQMAAFITKLFDDPSQSSELLSEAKKLNDSQAPK | 1111 |
| Z14718 | VDAKYAKEEAWREIHILPNLTISQMAAFITKLFDDPSQSSELLSEAKKLNDSQAPK | 1112 |
| Z14719 | VDAKYAKEEKKAWHEIHILPNLTVDQMAAFITKLFDDPSQSSELLSEAKKLNDSQAPK | 1113 |
| Z14721 | VDAKYAKEEYHAWTEIHLLPNLTINQMAAFITKLFDDPSQSSELLSEAKKLNDSQAPK | 1114 |
| Z14723 | VDAKYAKEEFSAWYEIHLLPNLTVDQMAAFISKLFDDPSQSSELLSEAKKLNDSQAPK | 1115 |
| Z14724 | VDAKYAKEERAAWNEIHTLPNLTVDQMAAFITKLFDDPSQSSELLSEAKKLNDSQAPK | 1116 |
| Z14725 | VDAKYAKEEYEAWVEIHLLPNLTIDQMAAFITKLFDDPSQSSELLSEAKKLNDSQAPK | 1117 |
| Z14726 | VDAKYAKEEAFAWVEIHLLPNLTVNQMAAFITKLFDDPSQSSELLSEAKKLNDSQAPK | 1118 |
| Z14727 | VDAKYAKEEAKAWHEIHILPNLTITQIAAFITKLFDDPSQSSELLSEAKKLNDSQAPK | 1119 |
| Z14728 | VDAKYAKEEFYAWNEIHKLPNLTVNQMAAFITKLFDDPSQSSELLSEAKKLNDSQAPK | 1120 |
| Z14729 | VDAKYAKEEHAAWREIHALPNLTIEQMAAFISKLFDDPSQSSELLSEAKKLNDSQAPK | 1121 |
| Z14730 | VDAKYAKEEQRAWMEIHLLPNLTIEQIAAFISKLFDDPSQSSELLSEAKKLNDSQAPK | 1122 |

Figure 1ll

| Designation | Sequence | SEQ ID NO |
|---|---|---|
| Z14732 | VDAKYAKEERDAWTEIHKLPNLTVDQMAAFITKLFDDPSQSSELLSEAKKLNDSQAPK | 1123 |
| Z14733 | VDAKYAKEERDAWFEIHRLPNLTVDQMAAFITKLFDDPSQSSELLSEAKKLNDSQAPK | 1124 |
| Z14734 | VDAKYAKEESYAWTEIHKLPNLTTDQMAAFITKLFDDPSQSSELLSEAKKLNDSQAPK | 1125 |
| Z14735 | VDAKYAKEEKFAWKEIHILPNLTIDQIAAFITKLFDDPSQSSELLSEAKKLNDSQAPK | 1126 |
| Z14736 | VDAKYAKEEHRAWMEIHQLPNLTVDQMAAFITKLFDDPSQSSELLSEAKKLNDSQAPK | 1127 |
| Z14737 | VDAKYAKEERTAWFEIHKLPNLTVDQMAAFITKLFDDPSQSSELLSEAKKLNDSQAPK | 1128 |
| Z14738 | VDAKYAKEERYAWWEIHKLPNLTVEQVAAFITKLFDDPSQSSELLSEAKKLNDSQAPK | 1129 |
| Z14739 | VDAKYAKEEEEAWNEIHRLPNLTVVQMAAFISKLFDDPSQSSELLSEAKKLNDSQAPK | 1130 |
| Z14740 | VDAKYAKEEYEAWVEIHILPNLTVEQMAAFITKLFDDPSQSSELLSEAKKLNDSQAPK | 1131 |
| Z14741 | VDAKYAKEEYHAWTEIHLLPNLTIEQMAAFITKLFDDPSQSSELLSEAKKLNDSQAPK | 1132 |
| Z14742 | VDAKYAKEEYNAWYEIHVLPNLTIDQIAAFITKLFDDPSQSSELLSEAKKLNDSQAPK | 1133 |
| Z14743 | VDAKYAKEERKAWYEIHILPNLTVHQIAAFITKLFDDPSQSSELLSEAKKLNDSQAPK | 1134 |
| Z14744 | VDAKYAKEEWAAWIEIHSLPNLTVDQMAAFITKLFDDPSQSSELLSEAKKLNDSQAPK | 1135 |
| Z14745 | VDAKYAKEEAIAWSEIHSLPNLTVGQMAAFITKLFDDPSQSSELLSEAKKLNDSQAPK | 1136 |
| Z14747 | VDAKYAKEEKYAWTEIHILPNLTIDQMAAFITKLFDDPSQSSELLSEAKKLNDSQAPK | 1137 |
| Z14748 | VDAKYAKEEHTAWREIHLLPNLTISQMAAFITKLFDDPSQSSELLSEAKKLNDSQAPK | 1138 |
| Z14749 | VDAKYAKEEYTAWYEIHLLPNLTIEQMAAFISKLFDDPSQSSELLSEAKKLNDSQAPK | 1139 |
| Z14750 | VDAKYAKEEYEAWYEIHILPNLTVRQMAAFITKLFDDPSQSSELLSEAKKLNDSQAPK | 1140 |
| Z14751 | VDAKYAKEEKHAWTEIHLLPNLTISQMAAFITKLFDDPSQSSELLSEAKKLNDSQAPK | 1141 |
| Z14752 | VDAKYAKEEYTAWYEIHVLPNLTIRQMAAFITKLFDDPSQSSELLSEAKKLNDSQAPK | 1142 |
| Z14753 | VDAKYAKEEQRAWYEIHTLPNLTIDQMAAFITKLFDDPSQSSELLSEAKKLNDSQAPK | 1143 |
| Z14754 | VDAKYAKEEAVAWKEIHLLPNLTIDQIAAFISKLFDDPSQSSELLSEAKKLNDSQAPK | 1144 |
| Z14755 | VDAKYAKEEYRAWMEIHALPNLTIVQIAAFITKLFDDPSQSSELLSEAKKLNDSQAPK | 1145 |
| Z14756 | VDAKYAKEERSAWNEIHKLPNLTIDQMAAFITKLFDDPSQSSELLSEAKKLNDSQAPK | 1146 |
| Z14757 | VDAKYAKEEAEAWFEIHILPNLTVGQIAAFITKLFDDPSQSSELLSEAKKLNDSQAPK | 1147 |
| Z14758 | VDAKYAKEEKMAWNEIHKLPNLTVEQIAAFITKLFDDPSQSSELLSEAKKLNDSQAPK | 1148 |
| Z14759 | VDAKYAKEERTAWMEIHKLPNLTIDQMAAFITKLFDDPSQSSELLSEAKKLNDSQAPK | 1149 |
| Z14760 | VDAKYAKEEYEAWYEIHALPNLTLHQMAAFITKLFDDPSQSSELLSEAKKLNDSQAPK | 1150 |
| Z14761 | VDAKYAKEEYDAWFEIHVLPNLTVNQMAAFITKLFDDPSQSSELLSEAKKLNDSQAPK | 1151 |
| Z14762 | VDAKYAKEESLAWMEIHKLPNLTVDQVAAFITKLFDDPSQSSELLSEAKKLNDSQAPK | 1152 |
| Z14763 | VDAKYAKEERNAWWEIHLLPNLTVNQMAAFISKLFDDPSQSSELLSEAKKLNDSQAPK | 1153 |
| Z14764 | VDAKYAKEEKKAWKEIHLLPNLTFLQMAAFITKLFDDPSQSSELLSEAKKLNDSQAPK | 1154 |
| Z14766 | VDAKYAKEEKYAWTEIHNLPNLTILQMAAFITKLFDDPSQSSELLSEAKKLNDSQAPK | 1155 |

Figure 1JJ

| Designation | Sequence | SEQ ID NO |
|---|---|---|
| Z14768 | VDAKYAKEEYKAWVEIHLLPNLTVDQMAAFISKLFDDPSQSSELLSEAKKLNDSQAPK | 1156 |
| Z14769 | VDAKYAKEEHAAWLEIHLLPNLTVSQIAAFITKLFDDPSQSSELLSEAKKLNDSQAPK | 1157 |
| Z14770 | VDAKYAKEEYHAWWEIHALPNLTVEQMAAFITKLFDDPSQSSELLSEAKKLNDSQAPK | 1158 |
| Z14771 | VDAKYAKEERYAWNEIHRLPNLTVDQMAAFITKLFDDPSQSSELLSEAKKLNDSQAPK | 1159 |
| Z14772 | VDAKYAKEEAQAWMEIHLLPNLTIAQMAAFITKLFDDPSQSSELLSEAKKLNDSQAPK | 1160 |
| Z14773 | VDAKYAKEEREAWYEIHILPNLTVNQMAAFITKLFDDPSQSSELLSEAKKLNDSQAPK | 1161 |
| Z14774 | VDAKYAKEEAYAWNEIHKLPNLTVEQMAAFITKLFDDPSQSSELLSEAKKLNDSQAPK | 1162 |
| Z14775 | VDAKYAKEEYDAWAEIHRLPNLTISQMAAFITKLFDDPSQSSELLSEAKKLNDSQAPK | 1163 |
| Z14776 | VDAKYAKEEYHAWTEIHILPNLTINQIAAFITKLFDDPSQSSELLSEAKKLNDSQAPK | 1164 |
| Z14777 | VDAKYAKEERQAWFEIHILPNLTVGQMAAFISKLFDDPSQSSELLSEAKKLNDSQAPK | 1165 |
| Z14778 | VDAKYAKEEAEAWFEIHILPNLTVDQIAAFITKLFDDPSQSSELLSEAKKLNDSQAPK | 1166 |
| Z14779 | VDAKYAKEEKKAWYEIHILPNLTVYQMAAFITKLFDDPSQSSELLSEAKKLNDSQAPK | 1167 |
| Z14780 | VDAKYAKEEKAAWHEIHILPNLTVHQMAAFITKLFDDPSQSSELLSEAKKLNDSQAPK | 1168 |
| Z14781 | VDAKYAKEEAQAWNEIHILPNLTVEQMAAFITKLFDDPSQSSELLSEAKKLNDSQAPK | 1169 |
| Z14785 | VDAKYAKEEYEAWYEIHILPNLTVHQIAAFITKLFDDPSQSSELLSEAKKLNDSQAPK | 1170 |
| Z14786 | VDAKYAKEEYEAWMEIHLLPNLTVHQMAAFITKLFDDPSQSSELLSEAKKLNDSQAPK | 1171 |
| Z14787 | VDAKYAKEEYDAWFEIHVLPNLTINQMAAFITKLFDDPSQSSELLSEAKKLNDSQAPK | 1172 |
| Z14789 | VDAKYAKEEKRAWNEIHQLPNLTHEQIAAFITKLFDDPSQSSELLSEAKKLNDSQAPK | 1173 |
| Z14790 | VDAKYAKEEARAWWEIHLLPNLTVDQIAAFITKLFDDPSQSSELLSEAKKLNDSQAPK | 1174 |
| Z14791 | VDAKYAKEEKHAWREIHILPNLTVDQIAAFITKLFDDPSQSSELLSEAKKLNDSQAPK | 1175 |
| Z14792 | VDAKYAKEESRAWTEIHLLPNLTVDQMAAFITKLFDDPSQSSELLSEAKKLNDSQAPK | 1176 |
| Z14793 | VDAKYAKEEAEAWKEIHLLPNLTIGQIAAFITKLFDDPSQSSELLSEAKKLNDSQAPK | 1177 |
| Z14794 | VDAKYAKEEADAWKEIHLLPNLTIEQMAAFITKLFDDPSQSSELLSEAKKLNDSQAPK | 1178 |
| Z14795 | VDAKYAKEEYQAWMEIHILPNLTIEQMAAFISKLFDDPSQSSELLSEAKKLNDSQAPK | 1179 |
| Z14796 | VDAKYAKEEAHAWWEIHKLPNLTVNQMAAFITKLFDDPSQSSELLSEAKKLNDSQAPK | 1180 |
| Z14797 | VDAKYAKEEWYAWNEIHKLPNLTVDQMAAFITKLFDDPSQSSELLSEAKKLNDSQAPK | 1181 |
| Z14798 | VDAKYAKEEKKAWNEIHNLPNLTVDQVAAFITKLFDDPSQSSELLSEAKKLNDSQAPK | 1182 |
| Z14799 | VDAKYAKEEAAAWMEIHGLPNLTVDQMAAFITKLFDDPSQSSELLSEAKKLNDSQAPK | 1183 |
| Z14800 | VDAKYAKEEFAWREIHILPNLTVEQMAAFITKLFDDPSQSSELLSEAKKLNDSQAPK | 1184 |
| Z14801 | VDAKYAKEEYHAWTEIHQLPNLTIDQMAAFISKLFDDPSQSSELLSEAKKLNDSQAPK | 1185 |
| Z14802 | VDAKYAKEEAMAWNEIHRLPNLTVNQMAAFISKLFDDPSQSSELLSEAKKLNDSQAPK | 1186 |
| Z14803 | VDAKYAKEEQKAWREIHILPNLTIDQMAAFITKLFDDPSQSSELLSEAKKLNDSQAPK | 1187 |
| Z14804 | VDAKYAKEEFAAWLEIHKLPNLTIDQMAAFITKLFDDPSQSSELLSEAKKLNDSQAPK | 1188 |

Figure 1KK

| Designation | Sequence | SEQ ID NO |
|---|---|---|
| Z14805 | VDAKYAKEEAYAWAEIHKLPNLTVNQMAAFITKLFDDPSQSSELLSEAKKLNDSQAPK | 1189 |
| Z14806 | VDAKYAKEEKDAWYEIHILPNLTVRQMAAFISKLFDDPSQSSELLSEAKKLNDSQAPK | 1190 |
| Z14807 | VDAKYAKEEKDAWMEIHLLPNLTVSQIAAFISKLFDDPSQSSELLSEAKKLNDSQAPK | 1191 |
| Z14808 | VDAKYAKEEKEAWTEIHKLPNLTINQMAAFISKLFDDPSQSSELLSEAKKLNDSQAPK | 1192 |
| Z14809 | VDAKYAKEEKDAWREIHILPNLTIDQMAAFISKLFDDPSQSSELLSEAKKLNDSQAPK | 1193 |
| Z14810 | VDAKYAKEEYRAWTEIHLLPNLTIEQMAAFISKLFDDPSQSSELLSEAKKLNDSQAPK | 1194 |
| Z14811 | VDAKYAKEEYRAWTEIHILPNLTVHQMAAFITKLFDDPSQSSELLSEAKKLNDSQAPK | 1195 |
| Z14812 | VDAKYAKEEWEAWLEIHALPNLTVEQMAAFITKLFDDPSQSSELLSEAKKLNDSQAPK | 1196 |
| Z14813 | VDAKYAKEEAAAWQEIHLLPNLTVGQIAAFITKLFDDPSQSSELLSEAKKLNDSQAPK | 1197 |
| Z14814 | VDAKYAKEEKVAWKEIHILPNLTVNQIAAFISKLFDDPSQSSELLSEAKKLNDSQAPK | 1198 |
| Z14815 | VDAKYAKEERVAWQEIHLLPNLTIEQMAAFITKLFDDPSQSSELLSEAKKLNDSQAPK | 1199 |
| Z14816 | VDAKYAKEEYEAWLEIHLLPNLTIDQMAAFITKLFDDPSQSSELLSEAKKLNDSQAPK | 1200 |
| Z14817 | VDAKYAKEEAEAWFEIHHNLPNLTIDQMAAFITKLFDDPSQSSELLSEAKKLNDSQAPK | 1201 |
| Z14818 | VDAKYAKEEKYAWWEIHKLPNLTVRQMAAFITKLFDDPSQSSELLSEAKKLNDSQAPK | 1202 |
| Z14819 | VDAKYAKEEYDAWHEIHVLPNLTVSQIAAFISKLFDDPSQSSELLSEAKKLNDSQAPK | 1203 |
| Z14820 | VDAKYAKEEAAAWREIHLLPNLTVDQMAAFITKLFDDPSQSSELLSEAKKLNDSQAPK | 1204 |
| Z14821 | VDAKYAKEEKHAWNEIHKLPNLTVKQVAAFISKLFDDPSQSSELLSEAKKLNDSQAPK | 1205 |
| Z14822 | VDAKYAKEEYDAWTEIHLLPNLTHIAQIAAFITKLFDDPSQSSELLSEAKKLNDSQAPK | 1206 |
| Z14823 | VDAKYAKEERKAWHEIHILPNLTVDQMAAFITKLFDDPSQSSELLSEAKKLNDSQAPK | 1207 |
| Z14824 | VDAKYAKEEHDAWHEIHLLPNLTVDQIAAFITKLFDDPSQSSELLSEAKKLNDSQAPK | 1208 |
| Z14825 | VDAKYAKEEYAAWNEIHKLPNLTIIQMAAFITKLFDDPSQSSELLSEAKKLNDSQAPK | 1209 |
| Z14826 | VDAKYAKEEYEAWMEIHLLPNLTIEQMAAFITKLFDDPSQSSELLSEAKKLNDSQAPK | 1210 |
| Z14827 | VDAKYAKEEKHAWTEIHLLPNLTVNQMAAFITKLFDDPSQSSELLSEAKKLNDSQAPK | 1211 |
| Z14828 | VDAKYAKEEKHAWIEIHALPNLTIDQMAAFITKLFDDPSQSSELLSEAKKLNDSQAPK | 1212 |
| Z14830 | VDAKYAKEEKYAWHEIHILPNLTVDQVAAFITKLFDDPSQSSELLSEAKKLNDSQAPK | 1213 |
| Z14831 | VDAKYAKEEKDAWHEIHILPNLTVDQMAAFITKLFDDPSQSSELLSEAKKLNDSQAPK | 1214 |
| Z14832 | VDAKYAKEEYHAWMEIHILPNLTIEQIAAFISKLFDDPSQSSELLSEAKKLNDSQAPK | 1215 |
| Z14833 | VDAKYAKEEYRAWHEIHILPNLTIQQMAAFITKLFDDPSQSSELLSEAKKLNDSQAPK | 1216 |
| Z14834 | VDAKYAKEEKHAWTEIHLLPNLTVQQMAAFITKLFDDPSQSSELLSEAKKLNDSQAPK | 1217 |
| Z14835 | VDAKYAKEEKFAWHEIHLLPNLTVNQMAAFITKLFDDPSQSSELLSEAKKLNDSQAPK | 1218 |
| Z14836 | VDAKYAKEEFAWREIHILPNLTISQIAAFITKLFDDPSQSSELLSEAKKLNDSQAPK | 1219 |
| Z14837 | VDAKYAKEEKMAWKEIHVLPNLTIGQMAAFITKLFDDPSQSSELLSEAKKLNDSQAPK | 1220 |
| Z14838 | VDAKYAKEEQYAWQEIHKLPNLTVEQMAAFITKLFDDPSQSSELLSEAKKLNDSQAPK | 1221 |

Figure 1LL

| Designation | Sequence | SEQ ID NO |
|---|---|---|
| Z14839 | VDAKYAKEEWEAWNEIHSLPNLTIDQIAAFITKLFDDPSQSSELLSEAKKLNDSQAPK | 1222 |
| Z14840 | VDAKYAKEEKMAWKEIHLLPNLTVEQMAAFITKLFDDPSQSSELLSEAKKLNDSQAPK | 1223 |
| Z14841 | VDAKYAKEEAHAWREIHNLPNLTTEQMAAFISKLFDDPSQSSELLSEAKKLNDSQAPK | 1224 |
| Z14842 | VDAKYAKEERRAWTEIHILPNLTVDQIAAFISKLFDDPSQSSELLSEAKKLNDSQAPK | 1225 |
| Z14843 | VDAKYAKEEYEAWMEIHLLPNLTINQIAAFITKLFDDPSQSSELLSEAKKLNDSQAPK | 1226 |
| Z14844 | VDAKYAKEEKHAWMEIHALPNLTIDQMAAFITKLFDDPSQSSELLSEAKKLNDSQAPK | 1227 |
| Z14845 | VDAKYAKEEHQAWHEIHILPNLTIQQMAAFITKLFDDPSQSSELLSEAKKLNDSQAPK | 1228 |
| Z14846 | VDAKYAKEEYYAWREIHLLPNLTIDQVAAFITKLFDDPSQSSELLSEAKKLNDSQAPK | 1229 |
| Z14847 | VDAKYAKEEQEAWMEIHKLPNLTVDQMAAFITKLFDDPSQSSELLSEAKKLNDSQAPK | 1230 |
| Z14848 | VDAKYAKEEAHAWTEIHSLPNLTVDQMAAFITKLFDDPSQSSELLSEAKKLNDSQAPK | 1231 |
| Z14849 | VDAKYAKEEKLAWKEIHLLPNLTISQMAAFITKLFDDPSQSSELLSEAKKLNDSQAPK | 1232 |
| Z14850 | VDAKYAKEEYDAWTEIHLLPNLTVDQMAAFISKLFDDPSQSSELLSEAKKLNDSQAPK | 1233 |
| Z14851 | VDAKYAKEEARAWMEIHNLPNLTVDQMAAFISKLFDDPSQSSELLSEAKKLNDSQAPK | 1234 |
| Z14852 | VDAKYAKEEYRAWTEIHLLPNLTVHQMAAFITKLFDDPSQSSELLSEAKKLNDSQAPK | 1235 |
| Z14853 | VDAKYAKEEYHAWYEIHILPNLTIHLPNLTVEQIAAFITKLFDDPSQSSELLSEAKKLNDSQAPK | 1236 |
| Z14854 | VDAKYAKEESDAWKEIHLLPNLTIEQMAAFITKLFDDPSQSSELLSEAKKLNDSQAPK | 1237 |
| Z14855 | VDAKYAKEEAYAWREIHILPNLTVDQMAAFITKLFDDPSQSSELLSEAKKLNDSQAPK | 1238 |
| Z14856 | VDAKYAKEEAAAWNEIHRLPNLTIDQMAAFITKLFDDPSQSSELLSEAKKLNDSQAPK | 1239 |
| Z14858 | VDAKYAKEEYHAWWEIHKLPNLTVNQMAAFITKLFDDPSQSSELLSEAKKLNDSQAPK | 1240 |
| Z14859 | VDAKYAKEEKAAWYEIHLLPNLTIDQMAAFITKLFDDPSQSSELLSEAKKLNDSQAPK | 1241 |
| Z14860 | VDAKYAKEEKEAWTEIHLLPNLTVDQIAAFITKLFDDPSQSSELLSEAKKLNDSQAPK | 1242 |
| Z14863 | VDAKYAKEEKRAWYEIHGLPNLTISQMAAFITKLFDDPSQSSELLSEAKKLNDSQAPK | 1243 |
| Z14864 | VDAKYAKEEARAWYEIHILPNLTVHQMAAFITKLFDDPSQSSELLSEAKKLNDSQAPK | 1244 |
| Z14865 | VDAKYAKEEKTAWVEIHKLPNLTINQMAAFITKLFDDPSQSSELLSEAKKLNDSQAPK | 1245 |
| Z14866 | VDAKYAKEERDAWFEIHILPNLTIHILPNLTIEQMAAFITKLFDDPSQSSELLSEAKKLNDSQAPK | 1246 |
| Z14869 | VDAKYAKEEAMANKEIHGLPNLTIEQMAAFISKLFDDPSQSSELLSEAKKLNDSQAPK | 1247 |
| Z14870 | VDAKYAKEEQYAWREIHLLPNLTVHQVAAFITKLFDDPSQSSELLSEAKKLNDSQAPK | 1248 |
| Z14871 | VDAKYAKEEWEAWIEIHNLPNLTVGQMAAFITKLFDDPSQSSELLSEAKKLNDSQAPK | 1249 |
| Z14872 | VDAKYAKEEYAAWTEIHTLPNLTVDQVAAFISKLFDDPSQSSELLSEAKKLNDSQAPK | 1250 |
| Z14873 | VDAKYAKEEDAWHEIHLLPNLTIEQMAAFITKLFDDPSQSSELLSEAKKLNDSQAPK | 1251 |
| Z14874 | VDAKYAKEEQYAWREIHALPNLTVEQMAAFITKLFDDPSQSSELLSEAKKLNDSQAPK | 1252 |
| Z14875 | VDAKYAKEEKRAWYEIHILPNLTVEQIAAFITKLFDDPSQSSELLSEAKKLNDSQAPK | 1253 |
| Z14876 | VDAKYAKEEYQAWIEIHILPNLTISQMAAFITKLFDDPSQSSELLSEAKKLNDSQAPK | 1254 |

Figure 1MM

| Designation | Sequence | SEQ ID NO |
|---|---|---|
| Z14877 | VDAKYAKEEKRAWYEIHLLPNLTIGQMAAFITKLFDDPSQSELLSEAKKLNDSQAPK | 1255 |
| Z14879 | VDAKYAKEEYLAWLEIHNLPNLTVDQMAAFITKLFDDPSQSELLSEAKKLNDSQAPK | 1256 |
| Z14880 | VDAKYAKEEYFAWYEIHNLPNLTVDQMAAFITKLFDDPSQSELLSEAKKLNDSQAPK | 1257 |
| Z14881 | VDAKYAKEEAFAWWEIHKLPNLTVEQMAAFITKLFDDPSQSSELLSEAKKLNDSQAPK | 1258 |
| Z14882 | VDAKYAKEESIAWQEIHLLPNLTIEQMAAFITKLFDDPSQSELLSEAKKLNDSQAPK | 1259 |
| Z14883 | VDAKYAKEEWDAWNEIHLLPNLTINQMAAFITKLFDDPSQSELLSEAKKLNDSQAPK | 1260 |
| Z14884 | VDAKYAKEEAYAWNEIHRLPNLTVEQMAAFITKLFDDPSQSELLSEAKKLNDSQAPK | 1261 |
| Z14885 | VDAKYAKEEAEAWFEIHKLPNLTVGQMAAFITKLFDDPSQSELLSEAKKLNDSQAPK | 1262 |
| Z14886 | VDAKYAKEEREAWHEIHILPNLTVEQVAAFITKLFDDPSQSELLSEAKKLNDSQAPK | 1263 |
| Z14887 | VDAKYAKEEHDAWMEIHLLPNLTIEQMAAFITKLFDDPSQSELLSEAKKLNDSQAPK | 1264 |
| Z14889 | VDAKYAKEEYSAWIEIHLLPNLTVSQMAAFITKLFDDPSQSSELLSEAKKLNDSQAPK | 1265 |
| Z14890 | VDAKYAKEEYDAWYEIHTLPNLTVDQVAAFITKLFDDPSQSELLSEAKKLNDSQAPK | 1266 |
| Z14891 | VDAKYAKEEKMAWTEIHNLPNLTIDQMAAFITKLFDDPSQSELLSEAKKLNDSQAPK | 1267 |
| Z14892 | VDAKYAKEEYAAWFEIHSLPNLTVEQMAAFITKLFDDPSQSELLSEAKKLNDSQAPK | 1268 |
| Z14893 | VDAKYAKEERRAWDEIHRLPNLTIEQMAAFITKLFDDPSQSELLSEAKKLNDSQAPK | 1269 |
| Z14894 | VDAKYAKEEYDAWLEIHLLPNLTVPNLTVLPNLTVKQIAAFITKLFDDPSQSELLSEAKKLNDSQAPK | 1270 |
| Z14895 | VDAKYAKEEYDAWNEIHTLPNLTIDQMAAFITKLFDDPSQSELLSEAKKLNDSQAPK | 1271 |
| Z14896 | VDAKYAKEEYDAWFEIHLLPNLTIDQMAAFITKLFDDPSQSELLSEAKKLNDSQAPK | 1272 |
| Z14897 | VDAKYAKEEAHAWTEIHKLPNLTIEQMAAFITKLFDDPSQSELLSEAKKLNDSQAPK | 1273 |
| Z14898 | VDAKYAKEEYRAWMEIHLLPNLTIDQMAAFITKLFDDPSQSELLSEAKKLNDSQAPK | 1274 |
| Z14899 | VDAKYAKEESAAWTEIHLLPNLTIEQMAAFITKLFDDPSQSELLSEAKKLNDSQAPK | 1275 |
| Z14900 | VDAKYAKEEYFAWTEIHVLPNLTVPNLTVKQIAAFITKLFDDPSQSELLSEAKKLNDSQAPK | 1276 |
| Z14901 | VDAKYAKEEFHAWSEIHLLPNLTVSQMAAFISKLFDDPSQSELLSEAKKLNDSQAPK | 1277 |
| Z14902 | VDAKYAKEEYDAWTEIHALPNLTVDQVAAFITKLFDDPSQSELLSEAKKLNDSQAPK | 1278 |
| Z14903 | VDAKYAKEEKAAWFEIHNLPNLTISQMAAFITKLFDDPSQSELLSEAKKLNDSQAPK | 1279 |
| Z14904 | VDAKYAKEEYQAWIEIHALPNLTIEQMAAFITKLFDDPSQSELLSEAKKLNDSQAPK | 1280 |
| Z14905 | VDAKYAKEEYDAWVEIHKLPNLTINQMAAFITKLFDDPSQSELLSEAKKLNDSQAPK | 1281 |
| Z14906 | VDAKYAKEEQSAWMEIHILPNLTVSQIAAFITKLFDDPSQSELLSEAKKLNDSQAPK | 1282 |
| Z14907 | VDAKYAKEERAAWNEIHSLPNLTVEQMAAFITKLFDDPSQSELLSEAKKLNDSQAPK | 1283 |
| Z14908 | VDAKYAKEEHEAWNEIHKLPNLTIDQMAAFITKLFDDPSQSELLSEAKKLNDSQAPK | 1284 |
| Z14909 | VDAKYAKEERFAWWEIHRLPNLTVRQVAAFISKLFDDPSQSELLSEAKKLNDSQAPK | 1285 |
| Z14910 | VDAKYAKEEFFAWYEIHILPNLTVEQMAAFITKLFDDPSQSELLSEAKKLNDSQAPK | 1286 |
| Z14911 | VDAKYAKEEKDAWNEIHRLPNLTVDQVAAFITKLFDDPSQSELLSEAKKLNDSQAPK | 1287 |

Figure 1NN

| Designation | Sequence | SEQ ID NO |
|---|---|---|
| Z14912 | VDAKYAKEEARAWYEIHVLPNLTVHQIAAFITKLFDDPSQSSELLSEAKKLNDSQAPK | 1288 |
| Z14913 | VDAKYAKEEERRAWNEIHKLPNLTVEQMAAFITKLFDDPSQSSELLSEAKKLNDSQAPK | 1289 |
| Z14914 | VDAKYAKEEYMAWDEIHRLPNLTVEQMAAFITKLFDDPSQSSELLSEAKKLNDSQAPK | 1290 |
| Z14915 | VDAKYAKEERNAWFEIHALPNLTIDQMAAFITKLFDDPSQSSELLSEAKKLNDSQAPK | 1291 |
| Z14916 | VDAKYAKEEAEAWQEIHLLPNLTVGQMAAFITKLFDDPSQSSELLSEAKKLNDSQAPK | 1292 |
| Z14917 | VDAKYAKEEKNAWYEIHLLPNLTIQQMAAFISKLFDDPSQSSELLSEAKKLNDSQAPK | 1293 |
| Z14918 | VDAKYAKEEAIAWHEIHLLPNLTITQMAAFISKLFDDPSQSSELLSEAKKLNDSQAPK | 1294 |
| Z14919 | VDAKYAKEEKDAWEEIHRLPNLTVTQMAAFISKLFDDPSQSSELLSEAKKLNDSQAPK | 1295 |
| Z14920 | VDAKYAKEEYDAWFEIHLLPNLTVQQIAAFITKLFDDPSQSSELLSEAKKLNDSQAPK | 1296 |
| Z14921 | VDAKYAKEEAAAWMEIHLLPNLTVEQMAAFITKLFDDPSQSSELLSEAKKLNDSQAPK | 1297 |
| Z14922 | VDAKYAKEERKAWNEIHQLPNLTIQQVAAFITKLFDDPSQSSELLSEAKKLNDSQAPK | 1298 |
| Z14923 | VDAKYAKEEYAAWWEIHALPNLTVEQVAAFITKLFDDPSQSSELLSEAKKLNDSQAPK | 1299 |
| Z14924 | VDAKYAKEEKEAAWMEIHILPNLTVDQMAAFITKLFDDPSQSSELLSEAKKLNDSQAPK | 1300 |
| Z14925 | VDAKYAKEEKIAWKEIHLLPNLTISQMAAFITKLFDDPSQSSELLSEAKKLNDSQAPK | 1301 |
| Z14926 | VDAKYAKEEHAAWMEIHLLPNLTVDQMAAFITKLFDDPSQSSELLSEAKKLNDSQAPK | 1302 |
| Z14927 | VDAKYAKEEKDAWYEIHILPNLTVDQMAAFITKLFDDPSQSSELLSEAKKLNDSQAPK | 1303 |
| Z14928 | VDAKYAKEERAAWNEIHKLPNLTIEQMAAFITKLFDDPSQSSELLSEAKKLNDSQAPK | 1304 |
| Z14930 | VDAKYAKEEAAAWFEIHILPNLTVGQIAAFITKLFDDPSQSSELLSEAKKLNDSQAPK | 1305 |
| Z14931 | VDAKYAKEEKFAWTEIHNLPNLTVDQMAAFITKLFDDPSQSSELLSEAKKLNDSQAPK | 1306 |
| Z14932 | VDAKYAKEEKFAWTEIHNLPNLTVDQMAAFITKLFDDPSQSSELLSEAKKLNDSQAPK | 1307 |
| Z14933 | VDAKYAKEEQRAWREIHILPNLTIDQMAAFITKLFDDPSQSSELLSEAKKLNDSQAPK | 1308 |
| Z14934 | VDAKYAKEEFQAWREIHLLPNLTIEQMAAFITKLFDDPSQSSELLSEAKKLNDSQAPK | 1309 |
| Z14935 | VDAKYAKEERMAWHEIHILPNLTVSQVAAFITKLFDDPSQSSELLSEAKKLNDSQAPK | 1310 |
| Z14936 | VDAKYAKEEKKAWYEIHILPNLTVNQIAAFITKLFDDPSQSSELLSEAKKLNDSQAPK | 1311 |
| Z14937 | VDAKYAKEEYYAWNEIHLLPNLTIVQVAAFITKLFDDPSQSSELLSEAKKLNDSQAPK | 1312 |
| Z14938 | VDAKYAKEEADAWREIHLLPNLTLEQVAAFITKLFDDPSQSSELLSEAKKLNDSQAPK | 1313 |
| Z14939 | VDAKYAKEEYEAWNEIHRLPNLTIDQMAAFITKLFDDPSQSSELLSEAKKLNDSQAPK | 1314 |
| Z14940 | VDAKYAKEEKKAWWEIHALPNLTVNQVAAFITKLFDDPSQSSELLSEAKKLNDSQAPK | 1315 |
| Z14941 | VDAKYAKEEKTAWREIHLLPNLTIEQMAAFITKLFDDPSQSSELLSEAKKLNDSQAPK | 1316 |
| Z14942 | VDAKYAKEEKDAWYEIHLLPNLTVDQIAAFITKLFDDPSQSSELLSEAKKLNDSQAPK | 1317 |
| Z14943 | VDAKYAKEEYTAWYEIHILPNLTIKQMAAFITKLFDDPSQSSELLSEAKKLNDSQAPK | 1318 |
| Z14945 | VDAKYAKEEYHAWYEIHLLPNLTIEQIAAFITKLFDDPSQSSELLSEAKKLNDSQAPK | 1319 |
| Z14946 | VDAKYAKEEAHAWREIHLLPNLTVLQMAAFITKLFDDPSQSSELLSEAKKLNDSQAPK | 1320 |

Figure 100

| Designation | Sequence | SEQ ID NO |
|---|---|---|
| Z14947 | VDAKYAKEEYEAWNEIHKLPNLTIDQMAAFITKLFDDPSQSSELLSEAKKLNDSQAPK | 1321 |
| Z14948 | VDAKYAKEERAAWNEIHALPNLTIDQMAAFITKLFDDPSQSSELLSEAKKLNDSQAPK | 1322 |
| Z14949 | VDAKYAKEEFDAWVEIHLLPNLTIDQMAAFITKLFDDPSQSSELLSEAKKLNDSQAPK | 1323 |
| Z14950 | VDAKYAKEEKAAWKEIHILPNLTVDQMAAFITKLFDDPSQSSELLSEAKKLNDSQAPK | 1324 |
| Z14951 | VDAKYAKEEWDAWLEIHALPNLTVDVAAFITKLFDDPSQSSELLSEAKKLNDSQAPK | 1325 |
| Z14953 | VDAKYAKEEYNAWYEIHSLPNLTVEQMAAFITKLFDDPSQSSELLSEAKKLNDSQAPK | 1326 |
| Z14954 | VDAKYAKEEWNAWNEIHKLPNLTVEQMAAFITKLFDDPSQSSELLSEAKKLNDSQAPK | 1327 |
| Z14955 | VDAKYAKEEKEAWFEIHILPNLTVEQIAAFISKLFDDPSQSSELLSEAKKLNDSQAPK | 1328 |
| Z14956 | VDAKYAKEEATAWWEIHKLPNLTVQQVAAFISKLFDDPSQSSELLSEAKKLNDSQAPK | 1329 |
| Z14957 | VDAKYAKEEYEAWYEIHILPNLTVGQIAAFITKLFDDPSQSSELLSEAKKLNDSQAPK | 1330 |
| Z14958 | VDAKYAKEEANAWKEIHLLPNLTVGQVAAFITKLFDDPSQSSELLSEAKKLNDSQAPK | 1331 |
| Z14959 | VDAKYAKEEKRAWHEIHVLPNLTVEQIAAFITKLFDDPSQSSELLSEAKKLNDSQAPK | 1332 |
| Z14960 | VDAKYAKEEYDAWVEIHLLPNLTIDQIAAFITKLFDDPSQSSELLSEAKKLNDSQAPK | 1333 |
| Z14961 | VDAKYAKEEAEAWFEIHILPNLTINQIAAFITKLFDDPSQSSELLSEAKKLNDSQAPK | 1334 |
| Z14962 | VDAKYAKEEWHAWNEIHKLPNLTIDQMAAFITKLFDDPSQSSELLSEAKKLNDSQAPK | 1335 |
| Z14963 | VDAKYAKEEYEAWFEIHILPNLTVDQIAAFITKLFDDPSQSSELLSEAKKLNDSQAPK | 1336 |
| Z14964 | VDAKYAKEEYEAWREIHLLPNLTVSQMAAFITKLFDDPSQSSELLSEAKKLNDSQAPK | 1337 |
| Z14965 | VDAKYAKEERAAWFEIHILPNLTISQMAAFITKLFDDPSQSSELLSEAKKLNDSQAPK | 1338 |
| Z14966 | VDAKYAKEEAQAWKEIHLLPNLTIEQMAAFISKLFDDPSQSSELLSEAKKLNDSQAPK | 1339 |
| Z14967 | VDAKYAKEEKAAWFEIHILPNLTIEQMAAFITKLFDDPSQSSELLSEAKKLNDSQAPK | 1340 |
| Z14968 | VDAKYAKEEYEAWIEIHNLPNLTIEQVAAFITKLFDDPSQSSELLSEAKKLNDSQAPK | 1341 |
| Z14969 | VDAKYAKEEKYAWVEIHKLPNLTVEQVAAFITKLFDDPSQSSELLSEAKKLNDSQAPK | 1342 |
| Z14970 | VDAKYAKEEYHAWWEIHLLPNLTVEQVAAFITKLFDDPSQSSELLSEAKKLNDSQAPK | 1343 |
| Z14971 | VDAKYAKEEKAAWMEIHLLPNLTIDQIAAFITKLFDDPSQSSELLSEAKKLNDSQAPK | 1344 |
| Z14972 | VDAKYAKEEYRAWIEIHILPNLTVEQMAAFISKLFDDPSQSSELLSEAKKLNDSQAPK | 1345 |
| Z14973 | VDAKYAKEEHDAWFEIHILPNLTIEQMAAFITKLFDDPSQSSELLSEAKKLNDSQAPK | 1346 |
| Z14974 | VDAKYAKEERNAWMEIHLLPNLTVDQMAAFITKLFDDPSQSSELLSEAKKLNDSQAPK | 1347 |
| Z14975 | VDAKYAKEEKHAWYEIHVLPNLTVDQMAAFITKLFDDPSQSSELLSEAKKLNDSQAPK | 1348 |
| Z14977 | VDAKYAKEEHDAWYEIHILPNLTIHQMAAFITKLFDDPSQSSELLSEAKKLNDSQAPK | 1349 |
| Z14978 | VDAKYAKEEKEANYEIHILPNLTVEQVAAFITKLFDDPSQSSELLSEAKKLNDSQAPK | 1350 |
| Z14979 | VDAKYAKEEAYAWREIHILPNLTVNQMAAFITKLFDDPSQSSELLSEAKKLNDSQAPK | 1351 |
| Z14980 | VDAKYAKEEAAAWMEIHLLPNLTVDQMAAFITKLFDDPSQSSELLSEAKKLNDSQAPK | 1352 |
| Z14981 | VDAKYAKEEYQAWTEIHTLPNLTVDQMAAFITKLFDDPSQSSELLSEAKKLNDSQAPK | 1353 |

Figure 1PP

| Designation | Sequence | SEQ ID NO |
|---|---|---|
| Z14982 | VDAKYAKEEKDAWYEIHLLPNLTVDQMAAFITKLFDDPSQSSELLSEAKKLNDSQAPK | 1354 |
| Z14983 | VDAKYAKEEANAWWEIHLLPNLTVEQMAAFITKLFDDPSQSSELLSEAKKLNDSQAPK | 1355 |
| Z14985 | VDAKYAKEEAKAWHEIHILPNLTTTQMAAFITKLFDDPSQSSELLSEAKKLNDSQAPK | 1356 |
| Z14986 | VDAKYAKEEWSAWVEIHSLPNLTVSQIAAFITKLFDDPSQSSELLSEAKKLNDSQAPK | 1357 |
| Z14987 | VDAKYAKEERRAWYEIHILPNLTVDQMAAFITKLFDDPSQSSELLSEAKKLNDSQAPK | 1358 |
| Z14988 | VDAKYAKEEKDAWFEIHVLPNLTVDQMAAFITKLFDDPSQSSELLSEAKKLNDSQAPK | 1359 |
| Z14989 | VDAKYAKEEKRAWLEIHNLPNLTIDQMAAFISKLFDDPSQSSELLSEAKKLNDSQAPK | 1360 |
| Z14991 | VDAKYAKEEHGAWTEIHLLPNLTIEQVAAFITKLFDDPSQSSELLSEAKKLNDSQAPK | 1361 |
| Z14993 | VDAKYAKEERKAWIEIHLLPNLTIEQMAAFITKLFDDPSQSSELLSEAKKLNDSQAPK | 1362 |
| Z14994 | VDAKYAKEERSAWTEIHLLPNLTIDQMAAFITKLFDDPSQSSELLSEAKKLNDSQAPK | 1363 |
| Z14995 | VDAKYAKEELKAWTEIHNLPNLTIDQMAAFITKLFDDPSQSSELLSEAKKLNDSQAPK | 1364 |
| Z14996 | VDAKYAKEEANAWYEIHILPNLTVDQVAAFITKLFDDPSQSSELLSEAKKLNDSQAPK | 1365 |
| Z14997 | VDAKYAKEEWQAWWEIHALPNLTVEQVAAFITKLFDDPSQSSELLSEAKKLNDSQAPK | 1366 |
| Z14998 | VDAKYAKEEYNAWLEIHSLPNLTVTQMAAFITKLFDDPSQSSELLSEAKKLNDSQAPK | 1367 |
| Z14999 | VDAKYAKEEKKAWTEIHTLPNLTVEQMAAFITKLFDDPSQSSELLSEAKKLNDSQAPK | 1368 |
| Z15000 | VDAKYAKEEKAAWYEIHLLPNLTVVQMAAFITKLFDDPSQSSELLSEAKKLNDSQAPK | 1369 |
| Z15001 | VDAKYAKEEKAAWREIHLLPNLTINQMAAFITKLFDDPSQSSELLSEAKKLNDSQAPK | 1370 |
| Z15002 | VDAKYAKEEFEAWVEIHLLPNLTIEQIAAFITKLFDDPSQSSELLSEAKKLNDSQAPK | 1371 |
| Z15004 | VDAKYAKEEYAAWVEIHNLPNLTVEQMAAFITKLFDDPSQSSELLSEAKKLNDSQAPK | 1372 |
| Z15005 | VDAKYAKEEESDAWYEIHTLPNLTIDQMAAFITKLFDDPSQSSELLSEAKKLNDSQAPK | 1373 |
| Z15006 | VDAKYAKEEKFAWTEIHILPNLTVDQMAAFITKLFDDPSQSSELLSEAKKLNDSQAPK | 1374 |
| Z15007 | VDAKYAKEEAEAWWEIHILPNLTVSQIAAFISKLFDDPSQSSELLSEAKKLNDSQAPK | 1375 |
| Z15008 | VDAKYAKEEYQAWFEIHLLPNLTINQMAAFITKLFDDPSQSSELLSEAKKLNDSQAPK | 1376 |
| Z15009 | VDAKYAKEEAKAWTEIHTLPNLTVDQMAAFITKLFDDPSQSSELLSEAKKLNDSQAPK | 1377 |
| Z15010 | VDAKYAKEEQLAWTEIHKLPNLTIEQIAAFITKLFDDPSQSSELLSEAKKLNDSQAPK | 1378 |
| Z15011 | VDAKYAKEEYDAWTEIHLLPNLTVEQMAAFITKLFDDPSQSSELLSEAKKLNDSQAPK | 1379 |
| Z15012 | VDAKYAKEEWDAWVEIHTLPNLTIHLPNLTIDQMAAFITKLFDDPSQSSELLSEAKKLNDSQAPK | 1380 |
| Z15013 | VDAKYAKEEFFAWHEIHILPNLTVQQMAAFITKLFDDPSQSSELLSEAKKLNDSQAPK | 1381 |
| Z15014 | VDAKYAKEEWEAWVEIHNLPNLTIDQMAAFITKLFDDPSQSSELLSEAKKLNDSQAPK | 1382 |
| Z15016 | VDAKYAKEERAAWWEIHGLPNLTVDQMAAFITKLFDDPSQSSELLSEAKKLNDSQAPK | 1383 |
| Z15017 | VDAKYAKEERDAWHEIHRLPNLTIEQMAAFISKLFDDPSQSSELLSEAKKLNDSQAPK | 1384 |
| Z15018 | VDAKYAKEEKTAWTEIHILPNLTIHQMAAFITKLFDDPSQSSELLSEAKKLNDSQAPK | 1385 |
| Z15019 | VDAKYAKEEFDAWMEIHLLPNLTINQMAAFITKLFDDPSQSSELLSEAKKLNDSQAPK | 1386 |

Figure 1QQ

| Designation | Sequence | SEQ ID NO |
|---|---|---|
| Z15020 | VDAKYAKEEHLAWVEIHNLPNLTVEQMAAFITKLFDDPSQSSELLSEAKKLNDSQAPK | 1387 |
| Z15021 | VDAKYAKEERHAWWEIHKLPNLTIEQMAAFITKLFDDPSQSSELLSEAKKLNDSQAPK | 1388 |
| Z15022 | VDAKYAKEEYDAWFEIHLLPNLTVEQMAAFITKLFDDPSQSSELLSEAKKLNDSQAPK | 1389 |
| Z15023 | VDAKYAKEEKWAWTEIHLLPNLTIEQMAAFISKLFDDPSQSSELLSEAKKLNDSQAPK | 1390 |
| Z15026 | VDAKYAKEEAKAWFEIHIHLPNLTIEQIAAFITKLFDDPSQSSELLSEAKKLNDSQAPK | 1391 |
| Z15027 | VDAKYAKEEYRAWTEIHLLPNLTTHQMAAFITKLFDDPSQSSELLSEAKKLNDSQAPK | 1392 |
| Z15028 | VDAKYAKEEKHAWTEIHILPNLTVEQMAAFITKLFDDPSQSSELLSEAKKLNDSQAPK | 1393 |
| Z15029 | VDAKYAKEEARAWTEIHTLPNLTIDQIAAFITKLFDDPSQSSELLSEAKKLNDSQAPK | 1394 |
| Z15030 | VDAKYAKEEYAAWVEIHSLPNLTVDQMAAFITKLFDDPSQSSELLSEAKKLNDSQAPK | 1395 |
| Z15032 | VDAKYAKEEYDAWYEIHLLPNLTINQMAAFITKLFDDPSQSSELLSEAKKLNDSQAPK | 1396 |
| Z15033 | VDAKYAKEEFNAWNEIHLLPNLTVTQMAAFITKLFDDPSQSSELLSEAKKLNDSQAPK | 1397 |
| Z15034 | VDAKYAKEEKAAWNEIHLLPNLTIDQMAAFISKLFDDPSQSSELLSEAKKLNDSQAPK | 1398 |
| Z15035 | VDAKYAKEERIAWFEIHILPNLTIKQMAAFITKLFDDPSQSSELLSEAKKLNDSQAPK | 1399 |
| Z15037 | VDAKYAKEEYKAWYEIHILPNLTVQQMAAFITKLFDDPSQSSELLSEAKKLNDSQAPK | 1400 |
| Z15038 | VDAKYAKEEQHAWYEIHILPNLTIDQMAAFITKLFDDPSQSSELLSEAKKLNDSQAPK | 1401 |
| Z15039 | VDAKYAKEERYAWFEIHALPNLTVSQMAAFITKLFDDPSQSSELLSEAKKLNDSQAPK | 1402 |
| Z15040 | VDAKYAKEEYKAWIEIHLLPNLTIDQIAAFISKLFDDPSQSSELLSEAKKLNDSQAPK | 1403 |
| Z15041 | VDAKYAKEERTAWFEIHLLPNLTVDQIAAFITKLFDDPSQSSELLSEAKKLNDSQAPK | 1404 |
| Z15043 | VDAKYAKEEKHAWWEIHLLPNLTINQMAAFITKLFDDPSQSSELLSEAKKLNDSQAPK | 1405 |
| Z15044 | VDAKYAKEEKMAWFEIHVLPNLTISQIAAFITKLFDDPSQSSELLSEAKKLNDSQAPK | 1406 |
| Z15045 | VDAKYAKEEFDAWTEIHLLPNLTVDQMAAFISKLFDDPSQSSELLSEAKKLNDSQAPK | 1407 |
| Z15046 | VDAKYAKEERDAWFEIHRLPNLTVSQMAAFITKLFDDPSQSSELLSEAKKLNDSQAPK | 1408 |
| Z15047 | VDAKYAKEEAVAWTEIHLLPNLTIDQMAAFITKLFDDPSQSSELLSEAKKLNDSQAPK | 1409 |
| Z15048 | VDAKYAKEEWYAWREIHILPNLTVEQVAAFITKLFDDPSQSSELLSEAKKLNDSQAPK | 1410 |
| Z15049 | VDAKYAKEEFHAWYEIHILPNLTVDQMAAFITKLFDDPSQSSELLSEAKKLNDSQAPK | 1411 |
| Z15050 | VDAKYAKEEYEAWTEIHLLPNLTVDQIAAFITKLFDDPSQSSELLSEAKKLNDSQAPK | 1412 |
| Z15051 | VDAKYAKEEWDAWTEIHALPNLTIDQMAAFISKLFDDPSQSSELLSEAKKLNDSQAPK | 1413 |
| Z15052 | VDAKYAKEESEAWTEIHLLPNLTIDQMAAFITKLFDDPSQSSELLSEAKKLNDSQAPK | 1414 |
| Z15054 | VDAKYAKEEFTAWSEIHNLPNLTVEQMAAFITKLFDDPSQSSELLSEAKKLNDSQAPK | 1415 |
| Z15055 | VDAKYAKEEADAWHEIHILPNLTVEQMAAFITKLFDDPSQSSELLSEAKKLNDSQAPK | 1416 |
| Z15056 | VDAKYAKEEKAAWFEIHILPNLTVEQMAAFITKLFDDPSQSSELLSEAKKLNDSQAPK | 1417 |
| Z15058 | VDAKYAKEERRAWHEIHILPNLTVEQMAAFISKLFDDPSQSSELLSEAKKLNDSQAPK | 1418 |
| Z15059 | VDAKYAKEERDAWWEIHKLPNLTVDQMAAFITKLFDDPSQSSELLSEAKKLNDSQAPK | 1419 |

Figure 1RR

| Designation | Sequence | SEQ ID NO |
|---|---|---|
| Z15060 | VDAKYAKEEAYAWKEIHILPNLTIDQMAAFISKLFDDPSQSSELLSEAKKLNDSQAPK | 1420 |
| Z15061 | VDAKYAKEEERAAWTEIHNLPNLTIDQMAAFITKLFDDPSQSSELLSEAKKLNDSQAPK | 1421 |
| Z15062 | VDAKYAKEEYAAWTEIHKLPNLTIDQMAAFITKLFDDPSQSSELLSEAKKLNDSQAPK | 1422 |
| Z15063 | VDAKYAKEERTAWMEIHGLPNLTIEQMAAFISKLFDDPSQSSELLSEAKKLNDSQAPK | 1423 |
| Z15064 | VDAKYAKEEWTAWNEIHLLPNLTIEQMAAFITKLFDDPSQSSELLSEAKKLNDSQAPK | 1424 |
| Z15065 | VDAKYAKEEKDAWFEIHILPNLTVHQIAAFISKLFDDPSQSSELLSEAKKLNDSQAPK | 1425 |
| Z15066 | VDAKYAKEEKSAWREIHLLPNLTIEQMAAFITKLFDDPSQSSELLSEAKKLNDSQAPK | 1426 |
| Z15068 | VDAKYAKEEYTAWLEIHALPNLTITQMAAFITKLFDDPSQSSELLSEAKKLNDSQAPK | 1427 |
| Z15069 | VDAKYAKEEKMAWMEIHKLPNLTIDQMAAFITKLFDDPSQSSELLSEAKKLNDSQAPK | 1428 |
| Z15070 | VDAKYAKEEYHAWYEIHLLPNLTVEQIAAFITKLFDDPSQSSELLSEAKKLNDSQAPK | 1429 |
| Z15071 | VDAKYAKEEKDAWFEIHLLPNLTVDQMAAFITKLFDDPSQSSELLSEAKKLNDSQAPK | 1430 |
| Z15072 | VDAKYAKEERAAWFEIHLLPNLTVEQMAAFITKLFDDPSQSSELLSEAKKLNDSQAPK | 1431 |
| Z15073 | VDAKYAKEEYMAWLEIHNLPNLTVEQMAAFITKLFDDPSQSSELLSEAKKLNDSQAPK | 1432 |
| Z15074 | VDAKYAKEEYIAWREIHLLPNLTIDQMAAFITKLFDDPSQSSELLSEAKKLNDSQAPK | 1433 |
| Z15075 | VDAKYAKEEKAAWHEIHVLPNLTISQMAAFITKLFDDPSQSSELLSEAKKLNDSQAPK | 1434 |
| Z15076 | VDAKYAKEEWQAWNEIHLLPNLTIDQMAAFITKLFDDPSQSSELLSEAKKLNDSQAPK | 1435 |
| Z15078 | VDAKYAKEEWEAWFEIHLLPNLTISQMAAFITKLFDDPSQSSELLSEAKKLNDSQAPK | 1436 |
| Z15080 | VDAKYAKEEYHAWWEIHKLPNLTVSQMAAFITKLFDDPSQSSELLSEAKKLNDSQAPK | 1437 |
| Z15081 | VDAKYAKEEYAAWVEIHALPNLTVEQMAAFITKLFDDPSQSSELLSEAKKLNDSQAPK | 1438 |
| Z15083 | VDAKYAKEEAAAWMEIHLLPNLTIDQIAAFITKLFDDPSQSSELLSEAKKLNDSQAPK | 1439 |
| Z15084 | VDAKYAKEERMAWHEIHLLPNLTVQQMAAFITKLFDDPSQSSELLSEAKKLNDSQAPK | 1440 |
| Z15085 | VDAKYAKEERDAWYEIHNLPNLTIDQMAAFITKLFDDPSQSSELLSEAKKLNDSQAPK | 1441 |
| Z15086 | VDAKYAKEESYAWNEIHKLPNLTVEQMAAFITKLFDDPSQSSELLSEAKKLNDSQAPK | 1442 |
| Z15087 | VDAKYAKEEKRAWKEIHILPNLTIDQMAAFITKLFDDPSQSSELLSEAKKLNDSQAPK | 1443 |
| Z15088 | VDAKYAKEEKEAWFEIHALPNLTVEQIAAFITKLFDDPSQSSELLSEAKKLNDSQAPK | 1444 |
| Z15089 | VDAKYAKEEYEAWNEIHLLPNLTVSQMAAFITKLFDDPSQSSELLSEAKKLNDSQAPK | 1445 |
| Z15090 | VDAKYAKEEAAAMMEIHLLPNLTIDQIAAFITKLFDDPSQSSELLSEAKKLNDSQAPK | 1446 |
| Z15091 | VDAKYAKEEERNAWEEIHLLPNLTINQIAAFITKLFDDPSQSSELLSEAKKLNDSQAPK | 1447 |
| Z15092 | VDAKYAKEEAYAWHEIHILPNLTVDQMAAFITKLFDDPSQSSELLSEAKKLNDSQAPK | 1448 |
| Z15093 | VDAKYAKEEANAWFEIHVLPNLTIEQMAAFITKLFDDPSQSSELLSEAKKLNDSQAPK | 1449 |
| Z15094 | VDAKYAKEEYDAWYEIHLLPNLTISQMAAFITKLFDDPSQSSELLSEAKKLNDSQAPK | 1450 |
| Z15095 | VDAKYAKEERLAWAEIHKLPNLTIEQVAAFITKLFDDPSQSSELLSEAKKLNDSQAPK | 1451 |
| Z15096 | VDAKYAKEERAAWNEIHILPNLTVQQMAAFITKLFDDPSQSSELLSEAKKLNDSQAPK | 1452 |

Figure 1SS

| Designation | Sequence | SEQ ID NO |
|---|---|---|
| Z15098 | VDAKYAKEEAAAWDEIHRLPNLTVDQIAAFITKLFDDPSQSSELLSEAKKLNDSQAPK | 1453 |
| Z15099 | VDAKYAKEEKEAWWEIHGLPNLTVNQMAAFITKLFDDPSQSSELLSEAKKLNDSQAPK | 1454 |
| Z15100 | VDAKYAKEERKAWYEIHTLPNLTINQMAAFITKLFDDPSQSSELLSEAKKLNDSQAPK | 1455 |
| Z15101 | VDAKYAKEERNAWYEIHILPNLTIEQMAAFITKLFDDPSQSSELLSEAKKLNDSQAPK | 1456 |
| Z15103 | VDAKYAKEEKLAWMEIHLLPNLTIEQMAAFITKLFDDPSQSSELLSEAKKLNDSQAPK | 1457 |
| Z15104 | VDAKYAKEEYMAWLEIHNLPNLTVDQMAAFITKLFDDPSQSSELLSEAKKLNDSQAPK | 1458 |
| Z15105 | VDAKYAKEESDAWREIHLLPNLTIEQMAAFISKLFDDPSQSSELLSEAKKLNDSQAPK | 1459 |
| Z15106 | VDAKYAKEEKEAWYEIHQLPNLTVNQMAAFITKLFDDPSQSSELLSEAKKLNDSQAPK | 1460 |
| Z15107 | VDAKYAKEEKQAWYEIHNLPNLTINQMAAFITKLFDDPSQSSELLSEAKKLNDSQAPK | 1461 |
| Z15108 | VDAKYAKEEYEAWTEIHRLPNLTIDQMAAFITKLFDDPSQSSELLSEAKKLNDSQAPK | 1462 |
| Z15109 | VDAKYAKEEKDAWYEIHVLPNLTISQMAAFITKLFDDPSQSSELLSEAKKLNDSQAPK | 1463 |
| Z15112 | VDAKYAKEERIAWYEIHILPNLTISQMAAFITKLFDDPSQSSELLSEAKKLNDSQAPK | 1464 |
| Z15113 | VDAKYAKEEQYAWTEIHLLPNLTIDQMAAFITKLFDDPSQSSELLSEAKKLNDSQAPK | 1465 |
| Z15114 | VDAKYAKEESDAWMEIHKLPNLTIDQMAAFITKLFDDPSQSSELLSEAKKLNDSQAPK | 1466 |
| Z15115 | VDAKYAKEEKFAWNEIHLLPNLTIEQMAAFITKLFDDPSQSSELLSEAKKLNDSQAPK | 1467 |
| Z15116 | VDAKYAKEERAAWYEIHLLPNLTVNQIAAFITKLFDDPSQSSELLSEAKKLNDSQAPK | 1468 |
| Z15118 | VDAKYAKEEFHAWWEIHKLPNLTVEQVAAFITKLFDDPSQSSELLSEAKKLNDSQAPK | 1469 |
| Z15119 | VDAKYAKEEKQAWLEIHILPNLTVGQIAAFITKLFDDPSQSSELLSEAKKLNDSQAPK | 1470 |
| Z15120 | VDAKYAKEEHLAWTEIHLLPNLTINQMAAFITKLFDDPSQSSELLSEAKKLNDSQAPK | 1471 |
| Z15121 | VDAKYAKEEATAWREIHLLPNLTIEQVAAFITKLFDDPSQSSELLSEAKKLNDSQAPK | 1472 |
| Z15123 | VDAKYAKEEKRAWYEIHILPNLTVEQVAAFITKLFDDPSQSSELLSEAKKLNDSQAPK | 1473 |
| Z15124 | VDAKYAKEEYEANTEIHLLPNLTVSQMAAFITKLFDDPSQSSELLSEAKKLNDSQAPK | 1474 |
| Z15125 | VDAKYAKEESNAWWEIHKLPNLTVNQVAAFITKLFDDPSQSSELLSEAKKLNDSQAPK | 1475 |
| Z15127 | VDAKYAKEEKRAWMEIHLLPNLTVDQIAAFITKLFDDPSQSSELLSEAKKLNDSQAPK | 1476 |
| Z15128 | VDAKYAKEEKFAWKEIHILPNLTVDQIAAFITKLFDDPSQSSELLSEAKKLNDSQAPK | 1477 |
| Z15130 | VDAKYAKEERDAWFEIHVLPNLTFILQMAAFITKLFDDPSQSSELLSEAKKLNDSQAPK | 1478 |
| Z15131 | VDAKYAKEEHYAWTEIHILPNLTVNQMAAFITKLFDDPSQSSELLSEAKKLNDSQAPK | 1479 |
| Z15132 | VDAKYAKEEKRAWMEIHLLPNLTVHQMAAFITKLFDDPSQSSELLSEAKKLNDSQAPK | 1480 |
| Z15133 | VDAKYAKEEYDAWVEIHLLPNLTVEQVAAFITKLFDDPSQSSELLSEAKKLNDSQAPK | 1481 |
| Z15134 | VDAKYAKEEHTANFEIHILPNLTISQIAAFITKLFDDPSQSSELLSEAKKLNDSQAPK | 1482 |
| Z15135 | VDAKYAKEELQAWKEIHILLPNLTVDQIAAFITKLFDDPSQSSELLSEAKKLNDSQAPK | 1483 |
| Z15136 | VDAKYAKEEYDAWLEIHLLPNLTISQIAAFITKLFDDPSQSSELLSEAKKLNDSQAPK | 1484 |
| Z15137 | VDAKYAKEEARAWREIHILPNLTVEQMAAFITKLFDDPSQSSELLSEAKKLNDSQAPK | 1485 |

Figure 1TT

| Designation | Sequence | SEQ ID NO |
|---|---|---|
| Z15138 | VDAKYAKEERNAWFEIHILPNLTIDQMAAFITKLFDDPSQSSELLSEAKKLNDSQAPK | 1486 |
| Z15139 | VDAKYAKEEAYAWHEIHVLPNLTIDQMAAFITKLFDDPSQSSELLSEAKKLNDSQAPK | 1487 |
| Z15143 | VDAKYAKEEYFAWTEIHKLPNLTTNQMAAFITKLFDDPSQSSELLSEAKKLNDSQAPK | 1488 |
| Z15144 | VDAKYAKEEAGAWYEIHLLPNLTVEQMAAFITKLFDDPSQSSELLSEAKKLNDSQAPK | 1489 |
| Z15146 | VDAKYAKEEKKAWYEIHILPNLTIEQMAAFISKLFDDPSQSSELLSEAKKLNDSQAPK | 1490 |
| Z15147 | VDAKYAKEEKQAWFEIHLLPNLTIEQMAAFISKLFDDPSQSSELLSEAKKLNDSQAPK | 1491 |
| Z15148 | VDAKYAKEEWHAWLEIHNLPNLTIEQMAAFITKLFDDPSQSSELLSEAKKLNDSQAPK | 1492 |
| Z15149 | VDAKYAKEEKSAWIEIHNLPNLTINQMAAFITKLFDDPSQSSELLSEAKKLNDSQAPK | 1493 |
| Z15150 | VDAKYAKEEYQAWNEIHILPNLTINQIAAFITKLFDDPSQSSELLSEAKKLNDSQAPK | 1494 |
| Z15152 | VDAKYAKEEAYAWVEIHKLPNLTVTQVAAFISKLFDDPSQSSELLSEAKKLNDSQAPK | 1495 |
| Z15153 | VDAKYAKEEYDAWMEIHNLPNLTIEQMAAFITKLFDDPSQSSELLSEAKKLNDSQAPK | 1496 |
| Z15154 | VDAKYAKEEYEAWVEIHNLPNLTIEQIAAFITKLFDDPSQSSELLSEAKKLNDSQAPK | 1497 |
| Z15155 | VDAKYAKEEREAWNEIHLLPNLTIEQIAAFITKLFDDPSQSSELLSEAKKLNDSQAPK | 1498 |
| Z15156 | VDAKYAKEEKRAWYEIHILPNLTVGQMAAFITKLFDDPSQSSELLSEAKKLNDSQAPK | 1499 |
| Z15157 | VDAKYAKEEKEAWTEIHILPNLTVEQMAAFITKLFDDPSQSSELLSEAKKLNDSQAPK | 1500 |
| Z15161 | VDAKYAKEEFEAWFEIHKLPNLTVEQMAAFITKLFDDPSQSSELLSEAKKLNDSQAPK | 1501 |
| Z15163 | VDAKYAKETQHAWWEIHKLPNLTIEQMAAFITKLFDDPSQSSELLSEAKKLNDSQAPK | 1502 |
| Z06777 | VDAKYAKEESQAWTEIHLLPNLTIEQMAAFISKLFDDPSQSSELLSEAKKLNDSQAPK | 1503 |
| Z06779 | VDAKYAKEERKAWFEIHLLPNLTTQQRSAFISKLFDDPSQSSELLSEAKKLNDSQAPK | 1504 |
| Z06789 | VDAKYAKEERSAWFEIHTLPNLFVQQIAAFIWKLYDDPSQSSELLSEAKKLNDSQAPK | 1505 |
| Z06791 | VDAKYAKEERQAWWEIHSLPNLTVDQMAAFIVKLMDDPSQSSELLSEAKKLNDSQAPK | 1506 |
| Z06792 | VDAKYAKEQAKAWWEIHVLPNLTVHQVAAFITKLFDDPSQSSELLSEAKKLNDSQAPK | 1507 |
| Z06799 | VDAKYAKEERDAWHEIQILPNLTITQMAAFISKLFDDPSQSSELLSEAKKLNDSQAPK | 1508 |
| Z06802 | VDAKYAKEEQRAWTEIHVLPNLTVQQMAAFITKLFDDPSQSSELLSEAKKLNDSQAPK | 1509 |
| Z06805 | VDAKYAKETQHAWWEIHKLPNLTVSQMAAFITKLFDDPSQSSELLSEAKKLNDSQAPK | 1510 |
| Z06809 | VDAKYAKEDRTAWWEIHLLPNLTAEQMAAFITKLFDDPSQSSELLSEAKKLNDSQAPK | 1511 |
| Z06814 | VDAKYAKEERDAWREIHALPNLFVDQLVAFITKLFDDPSQSSELLSEAKKLNDSQAPK | 1512 |
| Z06829 | VDAKYAKEEQRAWREIHLLPNLTIEQMAAFIWKLLDDPSQSSELLSEAKKLNDSQAPK | 1513 |
| Z06834 | VDAKYAKEEQRAWTEIHVLPNLTVSQMSAFISKLFDDPSQSSELLSEAKKLNDSQAPK | 1514 |
| Z06844 | VDAKYAKEEHQAWNEIHLLPNLTVNQMAAFITKLFDDPSQSSELLSEAKKLNDSQAPK | 1515 |
| Z06776 | VDAKYAKEEHAAWLEIHILPNLTVKQMAAFIGKLMDDPSQSSELLSEAKKLNDSQAPK | 1516 |
| Z06778 | VDAKYAKEERSAWFEIHLLPNLTISQKSAFIVKLFDDPSQSSELLSEAKKLNDSQAPK | 1517 |
| Z06780 | VDAKYAKEERSAWYEIHLLPNLTADQMAAFIQKLFDDPSQSSELLSEAKKLNDSQAPK | 1518 |

Figure 1UU

| Designation | Sequence | SEQ ID NO |
|---|---|---|
| Z06787 | VDAKYAKEEQRAWYEIHLLPNLTIEQLTAFIMKLMDDPSQSSELLSEAKKLNDSQAPK | 1519 |
| Z06788 | VDAKYAKEERQAWWEITILPNLTIEQVAAFITKLFDDPSQSSELLSEAKKLNDSQAPK | 1520 |
| Z06793 | VDAKYAKEDYEAWVEIHVLPNLTVEQKAAFIVKLFDDPSQSSELLSEAKKLNDSQAPK | 1521 |
| Z06794 | VDAKYAKEVYNAWHEIHVLPNLTTLQISAFISKLFDDPSQSSELLSEAKKLNDSQAPK | 1522 |
| Z06796 | VDAKYAKEERKAWWEIHLLPNLTIEQRTAAFIWKLLDDPSQSSELLSEAKKLNDSQAPK | 1523 |
| Z06797 | VDAKYAKEEQAAWWEIHMLPNLTIEQRTAFIIKLFDDPSQSSELLSEAKKLNDSQAPK | 1524 |
| Z06806 | VDAKYAKEEQTAWFEIHILPNLTVNQRVAFITKLFDDPSQSSELLSEAKKLNDSQAPK | 1525 |
| Z06808 | VDAKYAKEEALAWREIHLLPNLTVQISAFIAKLLDDPSQSSELLSEAKKLNDSQAPK | 1526 |
| Z06810 | VDAKYAKEEKFAWTEIHLLPNLTIGQQAAFIWKLFDDPSQSSELLSEAKKLNDSQAPK | 1527 |
| Z06811 | VDAKYAKEERAAWWEIHVLPNLTVSQMYAFITKLFDDPSQSSELLSEAKKLNDSQAPK | 1528 |
| Z06812 | VDAKYAKEEQRAWYEIHLLPNLTVRQRGAFITKLFDDPSQSSELLSEAKKLNDSQAPK | 1529 |
| Z06815 | VDAKYAKEHRQAWMEIHLLPNLTIRQIAAFIAKLFDDPSQSSELLSEAKKLNDSQAPK | 1530 |
| Z06823 | VDAKYAKEEKVAWHEIHVLPNLTVSQISAFITKLFDDPSQSSELLSEAKKLNDSQAPK | 1531 |
| Z06824 | VDAKYAKEEKHAWYEIHLLPNLTISQLSAFIMKLFDDPSQSSELLSEAKKLNDSQAPK | 1532 |
| Z06830 | VDAKYAKESAFAWWEIHLLPNLTVEQIAAFIWKLLDDPSQSSELLSEAKKLNDSQAPK | 1533 |
| Z06836 | VDAKYAKEEQVAWREIHVLPNLTVEQVKAFINKLFDDPSQSSELLSEAKKLNDSQAPK | 1534 |
| Z06838 | VDAKYAKEEMDAWTEIHILPNLTVEQMEAFIVKLFDDPSQSSELLSEAKKLNDSQAPK | 1535 |
| Z06839 | VDAKYAKEEGRAWYEIHALPNLTVEQMSAFIIKLFDDPSQSSELLSEAKKLNDSQAPK | 1536 |
| Z06841 | VDAKYAKEERNAWFEIHILPNLTLSQITAFIWKLLDDPSQSSELLSEAKKLNDSQAPK | 1537 |
| Z06842 | VDAKYAKEEHNAWTEIHRLPNLTVKQTSAFIEKLFDDPSQSSELLSEAKKLNDSQAPK | 1538 |
| Z06845 | VDAKYAKEEFKAWWEIHVLPNLTADQVAAFIVKLFDDPSQSSELLSEAKKLNDSQAPK | 1539 |
| Z06846 | VDAKYAKEEQHMAWTEIHLLPNLTVAQMAAFIVKLFDDPSQSSELLSEAKKLNDSQAPK | 1540 |
| Z06854 | VDAKYAKEEQRAWWEIHLLPNLTARQTAAFIWKLMDDPSQSSELLSEAKKLNDSQAPK | 1541 |
| Z06855 | VDAKYAKEEQKSAWTEIHLLPNLTVHQISAFIAKLLDDPSQSSELLSEAKKLNDSQAPK | 1542 |
| Z06856 | VDAKYAKEEHLAWKEIHKLPNLTVIQMAAFITKLFDDPSQSSELLSEAKKLNDSQAPK | 1543 |
| Z06857 | VDAKYAKEERAAWWEIHMLPNLTADQMAAFIAKLFDDPSQSSELLSEAKKLNDSQAPK | 1544 |
| Z06859 | VDAKYAKEQRTAWWEIHILPNLTVKQLVAFINKLFDDPSQSSELLSEAKKLNDSQAPK | 1545 |
| Z06861 | VDAKYAKEEQIAWFEIHLLPNLTVGQRTAFIVKLFDDPSQSSELLSEAKKLNDSQAPK | 1546 |
| Z06862 | VDAKYAKEERRAWFEISVLPNLTVDQTAAFIMKLFDDPSQSSELLSEAKKLNDSQAPK | 1547 |
| Z06864 | VDAKYAKEEADAWMEIHILPNLTVLQRSAFIIKLFDDPSQSSELLSEAKKLNDSQAPK | 1548 |
| Z06865 | VDAKYAKEREAWFEIHVLPNLTIKQISAFIHKLFDDPSQSSELLSEAKKLNDSQAPK | 1549 |
| Z06866 | VDAKYAKEERRAWFEIHTLPNLTVEQIEAFINKLFDDPSQSSELLSEAKKLNDSQAPK | 1550 |
| Z06871 | VDAKYAKEERAAWWEIHGLPNLTVWQTAAFIVKLFDDPSQSSELLSEAKKLNDSQAPK | 1551 |

Figure 1VV

| Designation | Sequence | SEQ ID NO |
|---|---|---|
| Z03638 | AEAKYAKELGWATWEIFNLPNLTGVQVKAFIDKLRDDPSQSSELLSEAKKLNDSQAPK | 1552 |
| Z04726 | VDAKYAKELGWATWEIFNLPNLTGVQVKAFIDKLRDDPSQSSELLSEAKKLNDSQAPK | 1553 |
| PP013 | LAEAKEAANAELDSYGVSDFYKRLIDKAKTVEGVEALKDAILAALP | 1554 |
| hIL-6 | PVPPGEDSKDVAAPHRQPLTSSERIDKQIRYILDGISALRKETCNKSNMCESSKEALAENNLNLPKMAEKDGCFQSGF NEETCLVKIITGLLEFEVYLEYLQNRFESSEEQARAVQMSTKVLIQFLQKKAKNLDAITTPDPTTNASLLTKLQAQNQ WLQDMTTHLILRSFKEFLQSSLRALRQM | 1555 |
| mIL-6 | MFPTSQVRRGDFTEDTTPNRPVYTTSQVGGLITHVLWEIVEMRKELCNGNSDCMNNDDALAENNLKLPEIQRNDGCYQ TGYNQEICLLKISSGLLEYHSYLEYMKNNLKDNKKDKARVLQRDTETLIHIFNQEVKDLHKIVLPTPISNALLTDKLE SQKEWLRTKTIQFILKSLEEFLKVTLRSTRQT | 1556 |
| HC_Ada | EVQLVESGGGLVQPGRSLRLSCAASGFTFDDYAMHWVRQAPGKGLEWVSAITWNSGHIDYADSVEGRFTISRDNAKNS LYLQMNSLRAEDTAVYYCAKVSYLSTASSLDYWGQGTLVTVSSASTKGPSVFPLAPSSKSTSGGTAALGCLVKDYFPE PVTVSWNSGALTSGVHTFPAVLQSSGLYSLSSVVTVPSSSLGTQTYICNVNHKPSNTKVDKKVEPKSCDKTHTCPPCP APELLGGPSVFLFPPKPKDTLMISRTPEVTCVVVDVSHEDPEVKFNWYVDGVEVHNAKTKPREEQYNSTYRVVSVLTV LHQDWLNGKEYKCKVSNKALPAPIEKTISKAKGQPREPQVYTLPPSREEMTKNQVSLTCLVKGFYPSDIAVEWESNGQ PENNYKTTPPVLDSDGSFFLYSKLTVDKSRWQQGNVFSCSVMHEALHNHYTQKSLSLSPGK | 1557 |
| LC_Ada | DIQMTQSPSSLSASVGDRVTITCRASQGIRNYLAWYQQKPGKAPKLLIYAASTLQSGVPSRFSGSGSGTDFTLTISSL QPEDVATYYCQRYNRAPYTFGQGTKVEIKRTVAAPSVFIFPPSDEQLKSGTASVVCLLNNFYPREAKVQWKVDNALQS GNSQESVTEQDSKDSTYSLSSTLTLSKADYEKHKVYACEVTHQGLSSPVTKSFNRGEC | 1558 |
| HC2_Ada | EVQLVESGGGLVQPGRSLRLSCAASGFTFDDYAMHWVRQAPGKGLEWVSAITWNSGHIDYADSVEGRFTISRDNAKNS LYLQMNSLRAEDTAVYYCAKVSYLSTASSLDYWGQGTLVTVSSASTKGPSVFPLAPSSKSTSGGTAALGCLVKDYFPE PVTVSWNSGALTSGVHTFPAVLQSSGLYSLSSVVTVPSSSLGTQTYICNVNHKPSNTKVDKKVEPKSCDKTHTCPPCP APELLGGPSVFLFPPKPKDTLMISRTPEVTCVVVDVSHEDPEVKFNVYVDGVEVHNAKTKPREEQYNSTYRVVSVLTV LHQDWLNGKEYKCKVSNKALPAPIEKTISKAKGQPREPQVYTLPPSRDELTKNQVSLTCLVKGFYPSDIAVEWESNGQ PENNYKTTPPVLDSDGSFFLYSKLTVDKSRWQQGNVFSCSVMHEALHNHYTQKSLSLSPGK | 1559 |

Figure 13
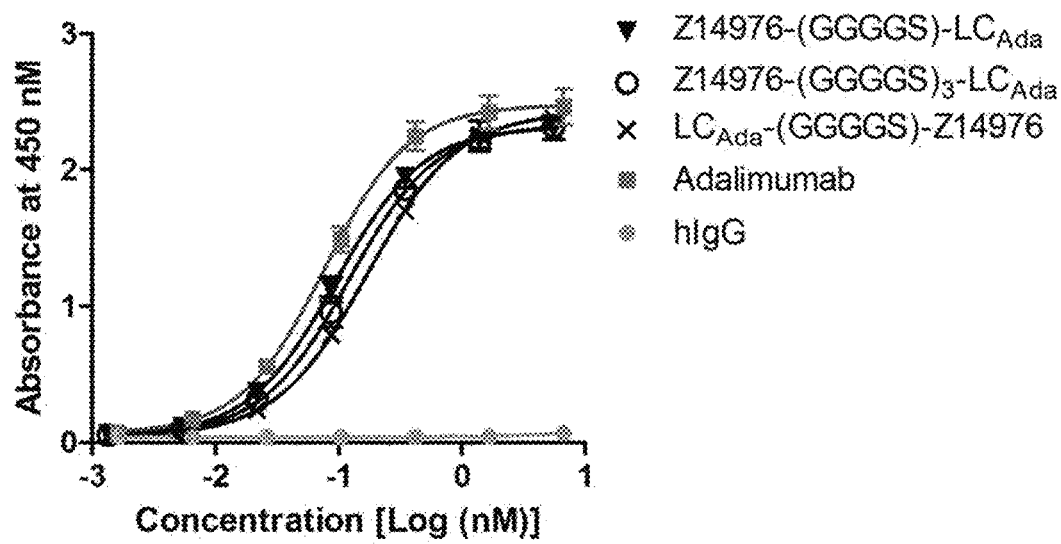
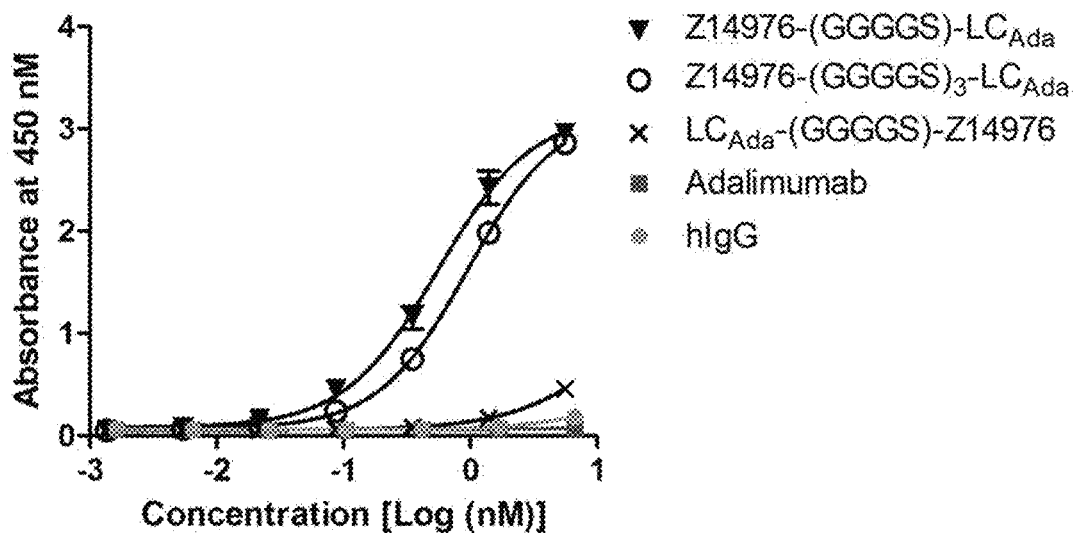

IL-6-BINDING POLYPEPTIDE COMPLEX

FIELD OF THE INVENTION

The present disclosure relates to a complex comprising an engineered polypeptide having affinity for interleukin-6 (in the following referred to as IL-6) and an antibody or an antigen binding fragment thereof, wherein said engineered polypeptide having affinity for IL-6 belongs to a class of engineered polypeptides comprising the sequence $EEX_3X_4AWX_7EIHX_{11}LPNLX16X_{17}X_{18}QX_{20}X_{21}AFIX25X_{26}LX_{28}X_{29}$ (SEQ ID NO:1565).

The present disclosure also relates to the use of said complex as a therapeutic agent.

BACKGROUND

Inflammation is a cytokine-driven response by the innate immune system to destroy for example pathogens and damaged cells. In some disease conditions, such as rheumatoid arthritis (RA) and Crohn's disease, the regulation of the inflammatory system is impaired leading to tissue damages. Among the most studied inducers of inflammation are the cytokines interleukin-6 (IL-6) and tumor necrosis factor (TNF). Different inhibitors of TNF are available for clinical use, such as the anti-TNF monoclonal antibodies adalimumab (HUMIRA) and infliximab (REMICADE) as well as the TNF receptor 2-Fc fusion etanercept (ENBREL). The antibody tocilizumab (ACTEMRA), which binds to the IL-6 receptor α (IL-6Rα) rather than the cytokine itself, has been approved for clinical use for IL-6 related disorders. The choice between an IL-6 or TNF blocking anti-inflammatory therapeutic strategy for treating RA is not trivial. Whereas anti-TNF strategies have so far been considered as standard (Taylor and Feldmann, 2009, Nature Reviews Rheumatology 5:578-582), a recent shoulder-to-shoulder monotherapy phase IV trial (ADACTA) in RA patients showed that tocilizumab was more effective than adalimumab in reducing RA-related symptoms (Gabay et al, 2013, Lancet 381: 1541-1550).

Human IL-6 consists of a single polypeptide chain of 184 amino acids with a molecular weight of 21 kDa, however a variable glycosylation pattern accounts for sizes varying between 21-26 kDa. IL-6 is secreted by a wide variety of cell types including T cells, B cells, monocytes, fibroblasts, hepatocytes, endothelial cells and keratinocytes. Downstream signaling induces the transition from acute inflammation to either acquired immunity or chronic inflammatory disease. IL-6 signaling and its regulation is complex and involves a number of factors and mechanisms. IL-6 signals via the classical IL-6 signaling pathway, also known as the cis-signaling pathway, or via the trans-signaling pathway. In the classical IL-6 signaling pathway, circulating IL-6 binds to a membrane bound IL-6 receptor α (IL-6Rα) followed by recruitment of the membrane anchored gp130 co-receptor, which results in the formation of a ternary complex. This complex subsequently dimerizes with a second adjacent ternary complex leading to signal transduction via the gp130 moieties (Boulanger et al., 2003, Science 300(5628): 2101-2104). In circulation, IL-6 can also exist bound to soluble ectodomains of IL-6Rα. Such complexes are responsible for the trans-signaling mechanism, involving IL-6 dependent activation of any cells that express the co-receptor gp130 but lack IL-6Rα (Chalaris et al, 2011, Eur J Cell Biol 90(6-7): 484-494; Assier et al, 2010, Joint Bone Spine 77(6):532-6). The trans-signaling, or pro-inflammatory, pathway has been suggested to be the pathway most related to disease conditions, and thus blocking of said pathway is of high interest. In contrast, the classical pathway is regarded to be responsible for important anti-inflammatory and regenerative processes (Scheller et al, 2011, Biochim Biophys Acta 1813(5): 878-888). Other drug candidates, in addition to tocilizumab, are being developed in order to address different IL-6 triggered pathways. These include the antibodies CNTO136 (sirukumab) (Xu et al, 2011, Br J Clin Pharmacol 72(2): 270-281; Zhuang et al, 2013, Int J Clin Pharmacol Ther 51(3):187-199) and MEDI5117 (Finch et al, 2011, J Mol Biol 411(4):791-807), which both bind to the IL-6 cytokine itself, as well as a gp130-Fc fusion CR5/18 aimed at selectively blocking the trans-signaling pathway (Kopf et al, 2010, Nat Rev Drug Discov 9(9):703-718, Chalaris et al, 2012, Dig Dis 30(5):492-499).

Recently, considerable progress has been made in the development of antibodies with ability to bind to more than one antigen, for example through engineering of the complementarity determining regions (CDRs) to address two antigens in a single antibody combining site (Bostrom et al, 2009, Science 323(5921):1610-1614, Schaefer et al, 2011, Cancer Cell 20(4):472-486), via construction of heterodimeric antibodies using engineered Fc units (Carter, 2001, J Immunol Methods 248(1-2):7-15; Schaefer et al, 2011, Proc Natl Acad Sci USA 108(27):11187-11192) and via genetic fusion of auxiliary recognition units to N- or C-termini of light or heavy chains of full-length antibodies (Kanakaraj et al, 2012, MAbs 4(5):600-613; LaFleur et al, 2013, MAbs 5(2):208-218).

Thus, there is a high unmet medical need that warrants the development of new modes of treatment for inflammatory and autoimmune disorders, such as for example various forms of rheumatoid arthritis and psoriasis, by blocking more than one factor associated with inflammatory and autoimmune disorders. The provision of agents with dual or even multiple affinity, such as agents with a high affinity for IL-6 and for one or more additional factor(s) associated with inflammatory and autoimmune disorders, is of high importance.

SUMMARY OF THE INVENTION

It is an object of the present disclosure to provide a new multispecific agent, such as a bispecific agent, which could for example be used for therapeutic applications.

It is an object of the present disclosure to provide a new multispecific agent, such as a bispecific agent, which has affinity for IL-6 and at least one additional antigen.

It is an object of the present disclosure to provide a molecule allowing for efficient therapy targeting various forms of inflammatory and autoimmune diseases while alleviating the abovementioned and other drawbacks of current therapies.

These and other objects which are evident to the skilled person from the present disclosure are met by different aspects of the invention as claimed in the appended claims and as generally disclosed herein.

Thus, in the first aspect of the disclosure, there is provided a complex comprising at least one IL-6 binding polypeptide and at least one antibody or an antigen binding fragment thereof, wherein said IL-6 binding polypeptide comprises an IL-6 binding motif BM, which motif consists of an amino acid sequence selected from i) $EEX_3X_4AWX_7EIHX_{11}LPNLX_{16}X_{17}X_{18}QX_{20}X_{21}AFIX_{25}X_{26}LX_{28}X_{29}$ (SEQ ID NO:1565)

wherein, independently from each other,
X$_3$ is selected from A, F, H, K, Q, R, S, W and Y;
X$_4$ is selected from A, D, E, F, H, I, K, L, M, N, Q, R, S, T, V and Y;
X$_7$ is selected from F, H, I, K, L, M, N, R, S, T, V, W and Y;
X$_{11}$ is selected from A, I, K, L, M, N, R, S, T and V;
X$_{16}$ is selected from N and T;
X$_{17}$ is selected from A, I, T and V;
X$_{18}$ is selected from D, E, G, H, K, N, Q, R, S and T;
X$_{20}$ is selected from I, L, M, R, T and V;
X$_{21}$ is selected from A, S, T and V;
X$_{26}$ is selected from I, M, Q, S, T, V and W;
X$_{26}$ is selected from K and S,
X$_{28}$ is selected from F, L, M and Y; and
X$_{29}$ is selected from D and R;
and
ii) an amino acid sequence which has at least 93% identity to the sequence defined in i).

When used herein to denote the first aspect of the disclosure, the term "complex" is intended to refer to two or more associated polypeptide chains, one having an affinity for IL-6 by virtue of its IL-6 binding motif as defined above, and the other being an antibody or an antigen binding fragment thereof. These polypeptide chains may each contain different protein domains, and the resulting multiprotein complex can have multiple functions. "Complex" intends to refer to two or more polypeptides as defined herein, connected by covalent bonds, for example two or more polypeptide chains connected by covalent bonds through expression thereof as a recombinant fusion protein, or associated by chemical conjugation.

The definition above of sequence-related, IL-6 binding polypeptides is based on a statistical analysis of a number of random polypeptide variants of a parent scaffold, that were selected for their interaction with IL-6 in several different selection experiments. The identified IL-6 binding motif, or "BM", corresponds to the target binding region of the parent scaffold, which region constitutes two alpha helices within a three-helical bundle protein domain. In the parent scaffold, the varied amino acid residues of the two BM helices constitute a binding surface for interaction with the constant Fc part of antibodies. In the present disclosure, the random variation of binding surface residues and subsequent selection of variants have replaced the Fc interaction capacity with a capacity for interaction with IL-6.

As the skilled person will realize, the function of any polypeptide, such as the IL-6 binding capacity of the polypeptide of the present disclosure, is dependent on the tertiary structure of the polypeptide. It is therefore possible to make minor changes to the sequence of amino acids in a polypeptide without affecting the function thereof. Thus, the disclosure encompasses modified variants of the IL-6 binding polypeptide, which are such that the IL-6 binding characteristics are retained.

In this way, also encompassed by the present disclosure is a complex as defined herein comprising an IL-6 binding polypeptide, which polypeptide comprises an amino acid sequence with 93% or greater identity to a polypeptide as defined in i). In some embodiments, the polypeptide may comprise a sequence which is at least 96% identical to a polypeptide as defined in i). For example, it is possible that an amino acid residue belonging to a certain functional grouping of amino acid residues (e.g. hydrophobic, hydrophilic, polar etc) could be exchanged for another amino acid residue from the same functional group.

In some embodiments, such changes may be made in any position of the sequence of the IL-6 binding polypeptide as disclosed herein. In other embodiments, such changes may be made only in the non-variable positions, also denoted scaffold amino acid residues. In such cases, changes are not allowed in the variable positions, i.e. positions denoted with an "X" in sequence i).

The term "% identity", as used throughout the specification, may for example be calculated as follows. The query sequence is aligned to the target sequence using the CLUSTAL W algorithm (Thompson et al, Nucleic Acids Research, 22:4673-4680 (1994)). A comparison is made over the window corresponding to the shortest of the aligned sequences. The shortest of the aligned sequences may in some instances be the target sequence. In other instances, the query sequence may constitute the shortest of the aligned sequences. The amino acid residues at each position are compared and the percentage of positions in the query sequence that have identical correspondences in the target sequence is reported as % identity.

As used herein "$X_n$" and "$X_m$" are used to indicate amino acids in positions n and m in the sequence i) as defined above, wherein n and m are integers which indicate the position of an amino acid within said sequence as counted from the N-terminal end of said sequence. For example, $X_3$ and $X_7$ indicate the amino acid in position three and seven, respectively, from the N-terminal end of sequence i).

In embodiments according to the first aspect, there is provided a complex, wherein $X_n$ in sequence i) is independently selected from a group of possible residues according to Table 1. The skilled person will appreciate that $X_n$ may be selected from any one of the listed groups of possible residues and that this selection is independent from the selection of amino acids in $X_m$, wherein n≠m. Thus, any of the listed possible residues in position $X_n$ in Table 1 may be independently combined with any of the listed possible residues in any other variable position in Table 1.

The skilled person will appreciate that Table 1 is to be read as follows: In one embodiment according to the first aspect, there is provided a complex as defined herein comprising at least one IL-6 binding polypeptide, wherein "$X_n$" in sequence i) is selected from "Possible residues". Thus, Table 1 discloses several specific and individualized embodiments of the first aspect of the present disclosure. For example, in one embodiment according to the first aspect, there is provided a complex wherein $X_3$ in sequence i) is selected from A, H, K, Q, R and Y, and in another embodiment according to the first aspect, there is provided a complex wherein $X_3$ in sequence i) is selected from A, K, Q, R and Y. For avoidance of doubt, the listed embodiments may be freely combined in yet other embodiments. For example, one such combined embodiment is a complex in which $X_3$ is selected from A, K, R and Y, while $X_4$ is selected from H and K, and $X_{11}$ is selected from A, I, L and T.

TABLE 1

Embodiments of the first aspect of the present disclosure

| $X_n$ | Possible residues |
|---|---|
| $X_3$ | A, F, H, K, Q, R, W, Y |
| $X_3$ | A, H, K, Q, R, S, W, Y |
| $X_3$ | A, H, K, Q, R, W, Y |
| $X_3$ | A, H, K, Q, R, Y |
| $X_3$ | A, K, Q, R, Y |
| $X_3$ | A, K, R, Y |
| $X_3$ | A, K, R |

TABLE 1-continued

Embodiments of the first aspect of the present disclosure

| $X_n$ | Possible residues |
|---|---|
| $X_3$ | A, R, Y |
| $X_3$ | K, R |
| $X_3$ | A, R |
| $X_3$ | R, Y |
| $X_3$ | R |
| $X_3$ | K |
| $X_3$ | A |
| $X_3$ | Y |
| $X_4$ | A, D, E, F, H, K, L, M, N, Q, R, S, T, V, Y |
| $X_4$ | A, D, E, F, H, I, K, M, N, Q, R, S, T, V, Y |
| $X_4$ | A, D, E, F, H, K, L, M, N, Q, R |
| $X_4$ | A, D, E, F, H, K, M, N, Q, R, S, T, V, Y |
| $X_4$ | A, D, E, F, H, K, N, Q, R, S, T, Y |
| $X_4$ | A, D, E, H, K, N, Q, R, S, T, Y |
| $X_4$ | A, D, E, H, K, Q, R, T |
| $X_4$ | A, D, E, F, H, K, M, Q, R, S, T, V, Y |
| $X_4$ | A, D, E, F, H, K, Q, R, S, T, V |
| $X_4$ | A, D, E, H, K, Q, R |
| $X_4$ | A, D, E, H, K, R |
| $X_4$ | D, E, H, K, R |
| $X_4$ | A, D, E, K, R |
| $X_4$ | A, D, E, H, K |
| $X_4$ | D, E, K, R |
| $X_4$ | A, D, E, K |
| $X_4$ | D, E, H, K |
| $X_4$ | D, H, K, Q |
| $X_4$ | E, H, K, R |
| $X_4$ | D, E, R |
| $X_4$ | D, E, K |
| $X_4$ | H, K, Q |
| $X_4$ | D, K, Q |
| $X_4$ | D, H, Q |
| $X_4$ | D, H, K |
| $X_4$ | E, H, K |
| $X_4$ | E, H, R |
| $X_4$ | H, K, R |
| $X_4$ | K, E, R |
| $X_4$ | D, E |
| $X_4$ | R, E |
| $X_4$ | K, E |
| $X_4$ | E, H |
| $X_4$ | D, K |
| $X_4$ | H, K |
| $X_4$ | K, Q |
| $X_4$ | K, D |
| $X_4$ | D, Q |
| $X_4$ | H, Q |
| $X_4$ | K |
| $X_4$ | H |
| $X_4$ | D |
| $X_4$ | Q |
| $X_4$ | E |
| $X_4$ | R |
| $X_7$ | F, H, I, K, L, M, N, R, T, V, W, Y |
| $X_7$ | F, H, I, K, L, M, N, R, T, W, Y |
| $X_7$ | F, H, I, L, M, N, R, T, W, Y |
| $X_7$ | F, H, K, L, M, N, R, S, T, V, W, Y |
| $X_7$ | F, H, K, L, M, N, R, T, V, W, Y |
| $X_7$ | F, H, K, L, M, N, R, T, W, Y |
| $X_7$ | F, H, L, M, N, R, T, W, Y |
| $X_7$ | F, H, R, T, W, Y |
| $X_7$ | F, I, N, R, T, W, Y |
| $X_7$ | F, I, R, W, Y |
| $X_7$ | F, N, R, W, Y |
| $X_7$ | F, R, T, W, Y |
| $X_7$ | F, H, T, W, Y |
| $X_7$ | F, H, W, Y |
| $X_7$ | F, T, W, Y |
| $X_7$ | F, R, W, Y |
| $X_7$ | F, H, L, M, R, T, V, W, Y |
| $X_7$ | F, H, R, T, W, Y |
| $X_7$ | I, R, W, Y |
| $X_7$ | F, W, Y |
| $X_7$ | F, R, Y |
| $X_7$ | R, W, Y |
| $X_7$ | I, R, Y |
| $X_7$ | I, W, Y |
| $X_7$ | F, Y |
| $X_7$ | W, Y |
| $X_7$ | I, Y |
| $X_7$ | R, Y |
| $X_7$ | F |
| $X_7$ | W |
| $X_7$ | Y |
| $X_7$ | I |
| $X_7$ | R |
| $X_{11}$ | A, I, K, L, N, R, S, T, V |
| $X_{11}$ | A, I, K, L, M, N, S, T, V |
| $X_{11}$ | A, I, K, L, N, S, T, V |
| $X_{11}$ | A, I, K, L, S, T, V |
| $X_{11}$ | A, I, K, L, N, T, V |
| $X_{11}$ | A, I, K, L, T, V |
| $X_{11}$ | A, I, K, L, T |
| $X_{11}$ | I, K, L, T |
| $X_{11}$ | A I, L, T |
| $X_{11}$ | A I, K, L |
| $X_{11}$ | A, K, L, N, S, T |
| $X_{11}$ | A, K, L, N, S |
| $X_{11}$ | A, K, L, S, T |
| $X_{11}$ | A, K, L, S |
| $X_{11}$ | K, L, S |
| $X_{11}$ | A, K, L |
| $X_{11}$ | A, I, L |
| $X_{11}$ | I, L |
| $X_{11}$ | A, L, N |
| $X_{11}$ | A, L |
| $X_{11}$ | L, N |
| $X_{11}$ | L |
| $X_{11}$ | A |
| $X_{11}$ | N |
| $X_{11}$ | S |
| $X_{11}$ | I |
| $X_{11}$ | K |
| $X_{11}$ | T |
| $X_{16}$ | N |
| $X_{16}$ | T |
| $X_{17}$ | I, T, V |
| $X_{17}$ | A, I, V |
| $X_{17}$ | I, V |
| $X_{17}$ | I |
| $X_{17}$ | V |
| $X_{18}$ | D, E, H, K, N, Q, R, S, T |
| $X_{18}$ | D, E, G, H, N, Q, R, S, T |
| $X_{18}$ | D, E, H, N, Q, R, S, T |
| $X_{18}$ | D, E, H, N, Q, S, T |
| $X_{18}$ | D, E, N, Q, S, T |
| $X_{18}$ | D, E, N, S, T |
| $X_{18}$ | D, E, Q, S, T |
| $X_{18}$ | D, E, S, T |
| $X_{18}$ | D, E, Q, S |
| $X_{18}$ | D, E, N, S |
| $X_{18}$ | D, E, S |
| $X_{18}$ | D, E, N |
| $X_{18}$ | D, E |
| $X_{18}$ | E |
| $X_{18}$ | D |
| $X_{20}$ | I, L, M, R, V |
| $X_{20}$ | I, M, R, T, V |
| $X_{20}$ | I, M, R, V |
| $X_{20}$ | I, L, M, V |
| $X_{20}$ | I, M, V |
| $X_{20}$ | I, M |
| $X_{20}$ | M, V |
| $X_{20}$ | M |

TABLE 1-continued

Embodiments of the first aspect of the present disclosure

| $X_n$ | Possible residues |
|---|---|
| $X_{21}$ | A, S, T |
| $X_{21}$ | A, S, V |
| $X_{21}$ | A, S |
| $X_{21}$ | A, V |
| $X_{21}$ | A, T |
| $X_{21}$ | A |
| $X_{25}$ | I, Q, S, T, V, W |
| $X_{25}$ | I, Q, S, T, V |
| $X_{25}$ | I, Q, S, T, W |
| $X_{25}$ | I, Q, S, T |
| $X_{25}$ | I, S, T |
| $X_{25}$ | Q, S, T |
| $X_{25}$ | S, T, W |
| $X_{25}$ | S, T |
| $X_{25}$ | S |
| $X_{25}$ | T |
| $X_{26}$ | K |
| $X_{26}$ | S |
| $X_{28}$ | F, L, Y |
| $X_{28}$ | F, M, Y |
| $X_{28}$ | F, L, M |
| $X_{28}$ | F, L |
| $X_{28}$ | F, Y |
| $X_{28}$ | F |
| $X_{29}$ | D |
| $X_{29}$ | R |

In one particular embodiment according to the first aspect, there is provided a complex as defined herein comprising at least one IL-6 binding polypeptide, wherein in sequence i), $X_3$ is selected from A, H, K, Q, R and Y;
$X_4$ is selected from A, D, E, F, H, I, K, L, M, N, Q, R, S, T, V and Y;
$X_7$ is selected from F, H, I, K, L, M, N, R, T, V, W and Y;
$X_{11}$ is selected from A, I, K, L, N, S, T and V;
$X_{16}$ is T;
$X_{17}$ is selected from A, I, T and V;
$X_{18}$ is selected from D, E, H, K, N, Q, R, S and T;
$X_{20}$ is selected from I, L, M, R and V;
$X_{21}$ is selected from A, S and V;
$X_{25}$ is selected from I, Q, S, T, V and W;
$X_{26}$ is K;
$X_{28}$ is selected from F, L, M and Y; and
$X_{29}$ is D.

In a more specific embodiment defining a sub-class of complexes comprising at least one IL-6 binding polypeptide, sequence i) fulfills at least six of the eleven conditions I-XI:

I. $X_3$ is selected from K and R;
II. $X_{11}$ is selected from A and L;
III. $X_{16}$ is T;
IV. $X_{17}$ is selected from I and V;
V. $X_{18}$ is selected from D and E;
VI. $X_{20}$ is M;
VII. $X_{21}$ is A;
VIII. $X_{25}$ is selected from S and T;
IX. $X_{26}$ is K;
X. $X_{28}$ is F; and
XI. $X_{29}$ is D.

In some examples of said complex according to the first aspect, sequence i) fulfils at least seven of the eleven conditions I-XI. More specifically, sequence i) may fulfill at least eight of the eleven conditions I-XI, such as at least nine of the eleven conditions I-XI, such as at least ten of the eleven conditions I-XI, such as all of the eleven conditions I-XI.

In some embodiments of a complex according to the first aspect, said complex comprises at least one IL-6 binding polypeptide, wherein in sequence i) $X_{17}X_{20}X_{21}$ is selected from VMA and IMA. In some embodiments, $X_{20}X_{21}X_{28}$ in sequence i) is MAF. In some embodiments, $X_{17}X_{20}X_{28}$ in sequence i) is selected from VMF and IMF. In some embodiments, $X_{17}X_{21}X_{28}$ in sequence i) is selected from VAF and IAF.

As described in detail in the experimental section to follow, the selection of IL-6 binding polypeptide variants has led to the identification of a number of individual IL-6 binding motif (BM) sequences, which constitute different embodiments of sequence i). Complexes comprising said different embodiments of sequence i) constitute individual embodiments of the complex according to the first aspect. The sequences of individual IL-6 binding motifs correspond to amino acid positions 8-36 in SEQ ID NO:1-1551 presented in FIG. 1A-UU. Hence, in one embodiment of a complex according to this aspect, sequence i) corresponds to the sequence from position 8 to position 36 in a sequence selected from the group consisting of SEQ ID NO:1-1551. In one embodiment, sequence i) corresponds to the sequence from position 8 to position 36 in a sequence selected from the group consisting of SEQ ID NO:1-1502. In one embodiment, sequence i) corresponds to the sequence from position 8 to position 36 in a sequence selected from the group consisting of SEQ ID NO:7, SEQ ID NO:15-89 and SEQ ID NO:151-871. In one embodiment, sequence i) corresponds to the sequence from position 8 to position 36 in a sequence selected from the group consisting of SEQ ID NO:1-6, SEQ ID NO:8-14, SEQ ID NO:90-150 and SEQ ID NO:872-1502. In one embodiment, sequence i) corresponds to the sequence from position 8 to position 36 in a sequence selected from the group consisting of SEQ ID NO:1-152 and SEQ ID NO:1503-1515. In one embodiment, sequence i) corresponds to the sequence from position 8 to position 36 in a sequence selected from the group consisting of SEQ ID NO:1-150 and SEQ ID NO:1503-1515. In one embodiment, sequence i) corresponds to the sequence from position 8 to position 36 in a sequence selected from the group consisting of SEQ ID NO:1-152. In another embodiment, sequence i) corresponds to the sequence from position 8 to position 36 in a sequence selected from the group consisting of SEQ ID NO:1-150. In yet another embodiment, sequence i) corresponds to the sequence from position 8 to position 36 in a sequence selected from the group consisting of SEQ ID NO:7, SEQ ID NO:15-89 and SEQ ID NO:151-152. In one embodiment, sequence i) corresponds to the sequence from position 8 to position 36 in a sequence selected from the group consisting of SEQ ID NO:1-6, SEQ ID NO:8-14 and SEQ ID NO:90-150. In one embodiment, sequence i) corresponds to the sequence from position 8 to position 36 in a sequence selected from the group consisting of SEQ ID NO:1-14 and SEQ ID NO:1503-1515. In one embodiment, sequence i) corresponds to the sequence from position 8 to position 36 in a sequence selected from the group consisting of SEQ ID NO:1-14 and SEQ ID NO:1512. In one embodiment, sequence i) corresponds to the sequence from position 8 to position 36 in a sequence selected from the group consisting of SEQ ID NO:1-14. In one embodiment, sequence i) corresponds to the sequence from position 8 to position 36 in a sequence selected from the group consisting of SEQ ID NO:1-5. In one embodiment, sequence i) corresponds to the sequence from position 8 to position 36 in SEQ ID NO:1512. In specific individual embodiments, sequence i) corresponds to the sequence from position 8 to position 36 in any one of SEQ ID NO:1-14 individually.

In some embodiments of the present disclosure, the BM as defined above "forms part of" a three-helix bundle protein domain. This is understood to mean that the sequence of the BM is "inserted" into or "grafted" onto the sequence of the original three-helix bundle domain, such that the BM replaces a similar structural motif in the original domain. For example, without wishing to be bound by theory, the BM is thought to constitute two of the three helices of a three-helix bundle, and can therefore replace such a two-helix motif within any three-helix bundle. As the skilled person will realize, the replacement of two helices of the three-helix bundle domain by the two BM helices has to be performed so as not to affect the basic structure of the polypeptide. That is, the overall folding of the Cα backbone of the polypeptide according to this embodiment of the invention is substantially the same as that of the three-helix bundle protein domain of which it forms a part, e.g. having the same elements of secondary structure in the same order etc. Thus, a BM according to the disclosure "forms part" of a three-helix bundle domain if the polypeptide according to this embodiment of the aspect has the same fold as the original domain, implying that the basic structural properties are shared, those properties e.g. resulting in similar CD spectra. The skilled person is aware of other parameters that are relevant.

In particular embodiments, the complex as defined herein comprises at least one IL-6 binding motif (BM), which forms part of a three-helix bundle protein domain. For example, the BM may essentially constitute two alpha helices with an interconnecting loop, within said three-helix bundle protein domain. In particular embodiments, said three-helix bundle protein domain is selected from domains of bacterial receptor proteins. Non-limiting examples of such domains are the five different three-helical domains of Protein A from *Staphylococcus aureus*, such as domain B, and derivatives thereof. In some embodiments, the three-helical bundle protein domain is a variant of protein Z, which is derived from domain B of staphylococcal Protein A.

In some embodiments of the complex as described herein, wherein said IL-6 binding polypeptide forms part of a three-helix bundle protein domain, the complex comprises at least one IL-6 binding polypeptide, which in turn comprises a binding module (BMod), the amino acid sequence of which is selected from:

iii)
K-[BM]-DPSQSX$_a$X$_b$LLX$_c$EAKKLX$_d$X$_e$X$_f$Q; (SEQ ID NO: 1566)

wherein

[BM] is an IL-6 binding motif as defined herein, provided that X$_{29}$ is ID,
  X$_a$ is selected from A and S,
  X$_b$ is selected from N and E;
  X$_c$ is selected from A, S and C;
  X$_d$ is selected from E, N and S,
  X$_e$ is selected from D, E and S,
  X$_f$ is selected from A and S, and
iv) an amino acid sequence which has at least 91% identity to a sequence defined by iii).

It may be beneficial in some embodiments that the complex as a whole, or at least part of the complex such as the IL-6 binding polypeptide, exhibits high structural stability, such as resistance to isomerization, to chemical modifications, to changes in physical conditions and to proteolysis, during production and storage, as well as in vivo. Thus, in other embodiments where the IL-6 binding polypeptide as disclosed herein forms part of a three-helix bundle protein domain, the complex comprises at least one IL-6 binding polypeptide, which in turn comprises a binding module (BMod), the amino acid sequence of which is selected from:

v)
K-[BM]-QPEQSX$_a$X$_b$LLX$_c$EAKKLX$_d$X$_e$X$_f$Q, (SEQ ID NO: 1567)

wherein
[BM] is an IL-6 binding motif as defined herein, provided that X$_{29}$ is R;
  X$_a$ is selected from A and S,
  X$_b$ is selected from N and E;
  X$_c$ is selected from A, S and C;
  X$_d$ is selected from E, N and S,
  X$_e$ is selected from D, E and S,
  X$_f$ is selected from A and S, and
vi) an amino acid sequence which has at least 91% identity to a sequence defined by v).

As discussed above, IL-6 binding polypeptides comprising minor changes as compared to the above amino acid, which do not largely affect the tertiary structure and the function of the polypeptide are also within the scope of the present disclosure. Thus, in some embodiments, the complex as defined herein comprises at least one IL-6 binding polypeptide, which comprises sequence iv) or vi) having at least 93%, such as at least 95%, such as at least 97% identity to a sequence defined by iii) and v), respectively.

In one embodiment, X$_a$ in sequence iii) or v) is A.
In one embodiment, X$_a$ in sequence iii) or v) is S.
In one embodiment, X$_b$ in sequence iii) or v) is N.
In one embodiment, X$_b$ in sequence iii) or v) is E.
In one embodiment, X$_c$ in sequence iii) or v) is A.
In one embodiment, X$_c$ in sequence iii) or v) is S.
In one embodiment, X$_c$ in sequence iii) or v) is C.
In one embodiment, X$_d$ in sequence iii) or v) is E.
In one embodiment, X$_d$ in sequence iii) or v) is N.
In one embodiment, X$_d$ in sequence iii) or v) is S.
In one embodiment, X$_e$ in sequence iii) or v) is D.
In one embodiment, X$_e$ in sequence iii) or v) is E.
In one embodiment, X$_e$ in sequence iii) or v) is S.
In one embodiment, X$_d$X$_e$ in sequence iii) or v) is selected from EE, ES, SE, SD and SS.
In one embodiment, X$_d$X$_e$ in sequence iii) or v) is ES.
In one embodiment, X$_d$X$_e$ in sequence iii) or v) is SE.
In one embodiment, X$_d$X$_e$ in sequence iii) or v) is SD.
In one embodiment, X$_f$ in sequence iii) or v) is A.
In one embodiment, X$_f$ in sequence iii) or v) is S.
In one embodiment, in sequence iii) or v), X$_a$ is A; X$_b$ is N; X$_c$ is A and X$_f$ is A.
In one embodiment, in sequence iii) or v), X$_a$ is A; X$_b$ is N; X$_c$ is C and X$_f$ is A.
In one embodiment, in sequence iii) or v), X$_a$ is S, X$_b$ is E; X$_c$ is S and X$_f$ is S.
In one embodiment, in sequence iii) or v), X$_a$ is S, X$_b$ is E; X$_c$ is C and X$_f$ is S.
In one embodiment, in sequence iii) or v), X$_a$ is A; X$_b$ is N; X$_c$ is A; X$_d$X$_e$ is ND and X$_f$ is A.
In one embodiment, in sequence iii) or v), X$_a$ is A; X$_b$ is N; X$_c$ is C; X$_d$X$_e$ is ND and X$_f$ is A.
In one embodiment, in sequence iii) or v), X$_a$ is S, X$_b$ is E; X$_c$ is S, X$_d$X$_e$ is ND and X$_f$ is S.
In one embodiment, in sequence iii) or v), X$_a$ is S, X$_b$ is E; X$_c$ is C; X$_d$X$_e$ is ND and X$_f$ is S.

In one embodiment, in sequence iii) or v), $X_a$ is A; $X_b$ is N; $X_c$ is A; $X_dX_e$ is SE and $X_f$ is A.

In one embodiment, in sequence iii) or v), $X_a$ is A; $X_b$ is N; $X_c$ is C; $X_dX_e$ is SE and $X_f$ is A.

In one embodiment, in sequence iii) or v), $X_a$ is S, $X_b$ is E; $X_c$ is S, $X_dX_e$ is SE and $X_f$ is S.

In one embodiment, in sequence iii) or v), $X_a$ is S, $X_b$ is E; $X_c$ is C; $X_dX_e$ is SE and $X_f$ is S.

In one embodiment, in sequence iii) or v), $X_a$ is A; $X_b$ is N; $X_c$ is A; $X_dX_e$ is SD and $X_f$ is A.

In one embodiment, in sequence iii) or v), $X_a$ is A; $X_b$ is N; $X_c$ is C; $X_dX_e$ is SD and $X_f$ is A.

In one embodiment, in sequence iii) or v), $X_a$ is S, $X_b$ is E; $X_c$ is S, $X_dX_e$ is SD and $X_f$ is S.

In one embodiment, in sequence iii) or v), $X_a$ is S, $X_b$ is E; $X_c$ is C; $X_dX_e$ is SD and $X_f$ is S.

In one embodiment, in sequence iii) or v), $X_a$ is A; $X_b$ is N; $X_e$ is A; $X_dX_e$ is ES and $X_f$ is A.

In one embodiment, in sequence iii) or v), $X_a$ is A; $X_b$ is N; $X_e$ is C; $X_dX_e$ is ES and $X_f$ is A.

In one embodiment, in sequence iii) or v), $X_a$ is S, $X_b$ is E; $X_c$ is S, $X_dX_e$ is ES and $X_f$ is S.

In one embodiment, in sequence iii) or v), $X_a$ is S, $X_b$ is E; $X_c$ is C; $X_dX_e$ is ES and $X_f$ is S.

In yet another embodiment of said complex, sequence iii) corresponds to the sequence from position 7 to position 55 in a sequence selected from the group consisting of SEQ ID NO:1-1551 presented in FIG. 1A-UU. In another embodiment, sequence iii) corresponds to the sequence from position 7 to position 55 in a sequence selected from the group consisting of SEQ ID NO:1-1502. In one embodiment, sequence iii) corresponds to the sequence from position 7 to position 55 in a sequence selected from the group consisting of SEQ ID NO:7, SEQ ID NO:15-89 and SEQ ID NO:151-871. In one embodiment, sequence iii) corresponds to the sequence from position 7 to position 55 in a sequence selected from the group consisting of SEQ ID NO:1-6, SEQ ID NO:8-14, SEQ ID NO:90-150 and SEQ ID NO:872-1502. In one embodiment, sequence iii) corresponds to the sequence from position 7 to position 55 in a sequence selected from the group consisting of SEQ ID NO:1-152 and SEQ ID NO:1503-1515. In one embodiment, sequence iii) corresponds to the sequence from position 7 to position 55 in a sequence selected from the group consisting of SEQ ID NO:1-150 and SEQ ID NO:1503-1515. In one embodiment, sequence iii) corresponds to the sequence from position 7 to position 55 in a sequence selected from the group consisting of SEQ ID NO:1-152. In another embodiment, sequence iii) corresponds to the sequence from position 7 to position 55 in a sequence selected from the group consisting of SEQ ID NO:1-150. In yet another embodiment, sequence iii) corresponds to the sequence from position 7 to position 55 in a sequence selected from the group consisting of SEQ ID NO:7, SEQ ID NO:15-89 and SEQ ID NO:151-152. In one embodiment, sequence iii) corresponds to the sequence from position 7 to position 55 in a sequence selected from the group consisting of SEQ ID NO:1-6, SEQ ID NO:8-14 and SEQ ID NO:90-150. In one embodiment, sequence iii) corresponds to the sequence from position 7 to position 55 in a sequence selected from the group consisting of SEQ ID NO:1-14 and SEQ ID NO:1503-1515. In one embodiment, sequence iii) corresponds to the sequence from position 7 to position 55 in a sequence selected from the group consisting of SEQ ID NO:1-14 and SEQ ID NO:1512. In one embodiment, sequence iii) corresponds to the sequence from position 7 to position 55 in a sequence selected from the group consisting of SEQ ID NO:1-14. In one embodiment, sequence iii) corresponds to the sequence from position 7 to position 55 in a sequence selected from the group consisting of SEQ ID NO:1-5. In one embodiment, sequence iii) corresponds to the sequence from position 7 to position 55 in SEQ ID NO:1512. In specific individual embodiments, sequence iii) corresponds to the sequence from position 7 to position 55 in any one of SEQ ID NO:1-14 individually.

Also, in a further embodiment, there is provided a complex as defined herein comprising at least one IL-6 binding polypeptide, wherein said IL-6 binding polypeptide comprises an amino acid sequence selected from:

vii) YA-[BMod]-AP (SEQ ID NO:1568), wherein [BMod] is an IL-6 binding module as defined above; and viii) an amino acid sequence which has at least 90% identity to a sequence defined by vii).

Alternatively, there is provided a complex as defined herein comprising at least one IL-6 binding polypeptide, wherein said IL-6 binding polypeptide comprises an amino acid sequence selected from:

ix) FN-[BMod]-AP (SEQ ID NO:1569), wherein [BMod] is an IL-6 binding module as defined above; and x) an amino acid sequence which has at least 90% identity to a sequence defined by ix).

As discussed above, IL-6 binding polypeptides comprising minor changes as compared to the above amino acid sequences, which do not largely affect the tertiary structure and the function of the polypeptide, also fall within the scope of the present disclosure. Thus, in some embodiments, sequence viii) and x) may for example be least 92%, such as at least 94%, such as at least 96%, such as at least 98% identical to a sequence defined by vii) and ix), respectively.

In some embodiments, the complex as defined herein comprises an IL-6 binding motif, which forms part of a polypeptide comprising an amino acid sequence selected from

ADNNFNK-[*BM*]-DPSQSANLLSEAKKLNESQAPK;
(SEQ ID NO: 1570)

ADNKFNK-[*BM*]-DPSQSANLLAEAKKLNDAQAPK;
(SEQ ID NO: 1571)

ADNKFNK-[*BM*]-DPSVSKEILAEAKKLNDAQAPK;
(SEQ ID NO: 1572)

ADAQQNNFNK-[*BM*]-DPSQSTNVLGEAKKLNESQAPK; (SEQ ID NO: 1573)

AQHDE-[*BM*]-DPSQSANVLGEAQKLNDSQAPK; (SEQ ID NO: 1574)

VDNKFNK-[*BM*]-DPSQSANLLAEAKKLNDAQAPK;
(SEQ ID NO: 1575)

AEAKYAK-[*BM*]-DPSESSELLSEAKKLNKSQAPK;
(SEQ ID NO: 1576)

VDAKYAK-[*BM*]-DPSQSSELLAEAKKLNDAQAPK;
(SEQ ID NO: 1577)

VDAKYAK-[*BM*]-DPSQSSELLAEAKKLNDSQAPK;
(SEQ ID NO: 1578)

AEAKYAK-[*BM*]-DPSQSSELLSEAKKLNDSQAPK;
(SEQ ID NO: 1579)

AEAKYAK-[*BM*]-DPSQSSELLSEAKKLSESQAPK;
(SEQ ID NO: 1580)

AEAKYAK-[*BM*]-QPEQSSELLSEAKKLSESQAPK;
(SEQ ID NO: 1581)

```
AEAKYAK-[BM]-DPSQSSELLSEAKKLESSQAPK;
(SEQ ID NO: 1582)

AEAKYAK-[BM]-QPEQSSELLSEAKKLESSQAPK;
(SEQ ID NO: 1583)

VDAKYAK-[BM]-DPSQSSELLSEAKKLNDSQAPK;
(SEQ ID NO: 1584)

VDAKYAK-[BM]-DPSQSSELLSEAKKLSESQAPK;
(SEQ ID NO: 1585)

VDAKYAK-[BM]-QPEQSSELLSEAKKLSESQAPK;
(SEQ ID NO: 1586)

VDAKYAK-[BM]-DPSQSSELLSEAKKLESSQAPK;
(SEQ ID NO: 1587)

VDAKYAK-[BM]-QPEQSSELLSEAKKLESSQAPK;
(SEQ ID NO: 1588)

VDAKYAK-[BM]-DPSQSSELLAEAKKLNKAQAPK;
(SEQ ID NO: 1589)
and

AEAKYAK-[BM]-DPSQSSELLAEAKKLNKAQAPK;
(SEQ ID NO: 1590)
``` wherein [BM] is an IL-6 binding motif as defined above.

In one embodiment, the complex as defined herein comprises an IL-6 binding motif, which comprises an amino acid sequence selected from:

```
xi)
VDAKYAK-[BM]-DPSQSSELLSEAKKLNDSQAPK;
(SEQ ID NO: 1584)
``` wherein [BM] is an IL-6 binding motif as defined above; and xii) an amino acid sequence which has at least 89% identity to the sequence defined in xi).

In another embodiment, the complex as defined herein comprises an IL-6 binding motif, which comprises an amino acid sequence selected from:

```
xiii)
AEAKYAK-[BM]-DPSQSSELLSEAKKLNDSQAPK;
(SEQ ID NO: 1579)
``` wherein [BM] is an IL-6 binding motif as defined above; and xiv) an amino acid sequence which has at least 89% identity to the sequence defined in xiii).

Again, polypeptides comprising minor changes as compared to the above amino acid sequences, which do not largely affect the tertiary structure and the function of the polypeptide, also fall within the scope of the present disclosure. Thus, in some embodiments, sequence xii) and xiv) may for example be at least 91%, such as at least 93%, such as at least 94%, such as at least 96%, such as at least 98% identical to the sequence defined by xi) and xiii), respectively.

Sequence xi) in such a polypeptide may be selected from the group consisting of SEQ ID NO:1-1551. In another embodiment, sequence xi) is selected from the group consisting of SEQ ID NO:1-1502. In one embodiment, sequence xi) is selected from the group consisting of SEQ ID NO:7, SEQ ID NO:15-89 and SEQ ID NO:151-871. In one embodiment, sequence xi) is selected from the group consisting of SEQ ID NO:1-6, SEQ ID NO:8-14, SEQ ID NO:90-150 and SEQ ID NO:872-1502. In one embodiment, sequence xi) is selected from the group consisting of SEQ ID NO:1-152 and SEQ ID NO:1503-1515. In one embodiment, sequence xi) is selected from the group consisting of SEQ ID NO:1-150 and SEQ ID NO:1503-1515. In one embodiment, sequence xi) is selected from the group consisting of SEQ ID NO:1-152. In another embodiment, sequence xi) is selected from the group consisting of SEQ ID NO:1-150. In yet another embodiment, sequence xi) is selected from the group consisting of SEQ ID NO:7, SEQ ID NO:15-89 and SEQ ID NO:151-152. In one embodiment, sequence xi) is selected from the group consisting of SEQ ID NO:1-6, SEQ ID NO:8-14 and SEQ ID NO:90-150. In one embodiment, sequence xi) is selected from the group consisting of SEQ ID NO:1-14 and SEQ ID NO:1503-1515. In one embodiment, sequence xi) is selected from the group consisting of SEQ ID NO:1-14 and SEQ ID NO:1512. In one embodiment, sequence xi) is selected from the group consisting of SEQ ID NO:1-14. In one embodiment, sequence xi) is selected from the group consisting of from SEQ ID NO:1-5. In one embodiment, sequence xi) is SEQ ID NO:1512. In specific individual embodiments, sequence xi) is any one of SEQ ID NO:1-14 individually.

The skilled person will understand that various modifications and/or additions can be made to an IL-6 binding polypeptide as defined herein, to an antibody or antigen binding fragment thereof, or to the complex as a whole as defined herein in order to tailor the complex to a specific application without departing from the scope of the present disclosure.

Thus, in one embodiment there is provided a complex as defined herein, wherein said IL-6 binding polypeptide and/or said antibody or antigen binding fragment thereof or said complex as a whole comprises additional amino acids at at least one C-terminal and/or N-terminal end. Such a complex should be understood as a complex having one or more additional amino acid residues at an N-terminal and/or C-terminal position in the polypeptide chain of the IL-6 binding polypeptide and/or of the antibody or antigen binding fragment thereof. Alternatively, if the complex is expressed as a fusion protein, said complex should be understood as having one or more additional amino acid residues at the N-terminal and/or C-terminal position of the complex as a whole. Thus, said complex may comprise any suitable number of additional amino acid residues, for example at least one additional amino acid residue. Each additional amino acid residue may individually or collectively be added in order to, for example, improve production, purification, stabilization in vivo or in vitro, coupling or detection of the complex. Such additional amino acid residues may comprise one or more amino acid residues added for the purpose of chemical coupling. One example of this is the addition of a cysteine residue. Additional amino acid residues may also provide a "tag" for purification or detection of the polypeptide, such as a $His_6$ tag, a $(HisGlu)_3$ tag ("HEHEHE" tag) (SEQ ID NO:1601) or a "myc" (c-myc) tag or a "FLAG" tag for interaction with antibodies specific to the tag or immobilized metal affinity chromatography (IMAC) in the case of a $His_6$-tag.

The further amino acids as discussed above may be coupled to an IL-6 binding polypeptide as defined herein, to an antibody or antigen binding fragment thereof or to said complex as a whole by means of chemical conjugation (using known organic chemistry methods) or by any other means, such as via expression of the IL-6 binding polypeptide, antibody or antigen binding fragment thereof or complex as a fusion protein or joined in any other fashion, either directly or via a linker, for example an amino acid linker.

In one embodiment, there is provided a complex as defined herein, wherein said IL-6 binding polypeptide is in a multimeric form. Said multimer is understood to comprise at least two IL-6 binding polypeptides as disclosed herein as monomer units, the amino acid sequences of which may be the same or different. Multimeric forms of the polypeptides may comprise a suitable number of domains, each having an IL-6 binding motif, and each forming a monomer within the multimer. These domains may have the same amino acid sequence, but alternatively, they may have different amino acid sequences. In other words, the complex according to the disclosure may comprise an IL-6 binding polypeptide in the form of homo- or heteromultimers, for example homo- or heterodimers. In one embodiment, there is provided a complex as defined herein, wherein the IL-6 binding polypeptide monomeric units are covalently coupled together. In another embodiment, said IL-6 binding polypeptide monomer units are expressed as a fusion protein. In one embodiment, there is provided an IL-6 binding polypeptide in dimeric form.

The present aspect provides a complex which comprises an antibody or an antigen binding fragment thereof. As is well known, antibodies are immunoglobulin molecules capable of specific binding to a target (an antigen), such as a carbohydrate, polynucleotide, lipid, polypeptide or other, through at least one antigen recognition site located in the variable region of the immunoglobulin molecule. As used herein, the term "antibody or an antigen binding fragment thereof" encompasses not only full-length or intact polyclonal or monoclonal antibodies, but also antigen-binding fragments thereof, such as Fab, Fab', F(ab')$_2$, Fab$_3$, Fv and variants thereof, fusion proteins comprising one or more antibody portions, humanized antibodies, chimeric antibodies, minibodies, diabodies, triabodies, tetrabodies, linear antibodies, single chain antibodies, multispecific antibodies (e.g., bispecific antibodies) and any other modified configuration of the immunoglobulin molecule that comprises an antigen recognition site of the required specificity, including glycosylation variants of antibodies, amino acid sequence variants of antibodies and covalently modified antibodies. Further examples of modified antibodies and antigen binding fragments thereof include nanobodies, AlbudAbs, DARTs (dual affinity re-targeting), BiTEs (bispecific T-cell engager), TandAbs (tandem diabodies), DAFs (dual acting Fab), two-in-one antibodies, SMIPs (small modular immunopharmaceuticals), FynomAbs (fynomers fused to antibodies), DVD-Igs (dual variable domain immunoglobulin), CovX-bodies (peptide modified antibodies), duobodies and triomAbs. This listing of variants of antibodies and antigen binding fragments thereof is not to be seen as limiting, and the skilled person is aware of other suitable variants.

A full-length antibody comprises two heavy chains and two light chains. Each heavy chain contains a heavy chain variable region ($V_H$) and first, second and third constant regions ($C_H1$, $C_H2$ and $C_H3$). Each light chain contains a light chain variable region ($V_L$) and a light chain constant region ($C_L$). Depending on the amino acid sequence of the constant domain of its heavy chains, antibodies are assigned to different classes. There are six major classes of antibodies: IgA, IgD, IgE, IgG, IgM and IgY, and several of these may be further divided into subclasses (isotypes), e.g., IgG1, IgG2, IgG3, IgG4, IgA1 and IgA2. The term "full-length antibody" as used herein refers to an antibody of any class, such as IgD, IgE, IgG, IgA, IgM or IgY (or any sub-class thereof). The subunit structures and three-dimensional configurations of different classes of antibodies are well known.

An "antigen binding fragment" is a portion or region of an antibody molecule, or a derivative thereof, that retains all or a significant part of the antigen binding of the corresponding full-length antibody. An antigen binding fragment may comprise the heavy chain variable region ($V_H$), the light chain variable region ($V_L$), or both. Each of the $V_H$ and $V_L$ typically contains three complementarity determining regions CDR1, CDR2 and CDR3. The three CDRs in $V_H$ or $V_L$ are flanked by framework regions (FR1, FR2, FR3 and FR4). As briefly listed above, examples of antigen binding fragments include, but are not limited to: (1) a Fab fragment, which is a monovalent fragment having a $V_L$-$C_L$ chain and a $V_H$-$C_H1$ chain; (2) a Fab' fragment, which is a Fab fragment with the heavy chain hinge region, (3) a F(ab')$_2$ fragment, which is a dimer of Fab' fragments joined by the heavy chain hinge region, for example linked by a disulfide bridge at the hinge region; (4) an Fc fragment; (5) an Fv fragment, which is the minimum antibody fragment having the $V_L$ and $V_H$ domains of a single arm of an antibody; (6) a single chain Fv (scFv) fragment, which is a single polypeptide chain in which the $V_H$ and $V_L$ domains of an scFv are linked by a peptide linker; (7) an (scFv)$_2$, which comprises two $V_H$ domains and two $V_L$ domains, which are associated through the two $V_H$ domains via disulfide bridges and (8) domain antibodies, which can be antibody single variable domain ($V_H$ or $V_L$) polypeptides that specifically bind antigens.

Antigen binding fragments can be prepared via routine methods. For example, F(ab')$_2$ fragments can be produced by pepsin digestion of a full-length antibody molecule, and Fab fragments can be generated by reducing the disulfide bridges of F(ab')$_2$ fragments. Alternatively, fragments can be prepared via recombinant technology by expressing the heavy and light chain fragments in suitable host cells (e.g., *E. coli*, yeast, mammalian, plant or insect cells) and having them assembled to form the desired antigen-binding fragments either in vivo or in vitro. A single-chain antibody can be prepared via recombinant technology by linking a nucleotide sequence coding for a heavy chain variable region and a nucleotide sequence coding for a light chain variable region. For example, a flexible linker may be incorporated between the two variable regions. The skilled person is aware of methods for the preparation of both full-length antibodies and antigen binding fragments thereof.

Thus, in one embodiment, this aspect of the disclosure provides a complex as defined herein, wherein said at least one antibody or antigen binding fragment thereof is selected from the group consisting of full-length antibodies, Fab fragments, Fab' fragments, F(ab')$_2$ fragments, Fc fragments, Fv fragments, single chain Fv fragments, (scFv)$_2$ and domain antibodies. In one embodiment, said at least one antibody or antigen binding fragment thereof is selected from full-length antibodies, Fab fragments and scFv fragments. In one particular embodiment, said at least one antibody or antigen binding fragment thereof is a full-length antibody.

In one embodiment of said complex as defined herein, the antibody or antigen binding fragment thereof is selected from the group consisting of monoclonal antibodies, human antibodies, humanized antibodies, chimeric antibodies, and antigen-binding fragments thereof.

The term "monoclonal antibodies" as used herein refers to antibodies having monovalent affinity, meaning that each antibody molecule in a sample of the monoclonal antibody binds to the same epitope on the antigen, whereas the term "polyclonal antibodies" as used herein refers to a collection of antibodies that react against a specific antigen, but in which collection there may be different antibody molecules for example identifying different epitopes on the antigen. Polyclonal antibodies are typically produced by inoculation of a suitable mammal and are purified from the mammal's serum. Monoclonal antibodies are made by identical immune cells that are clones of a unique parent cell (for example a hybridoma cell line). The term "human antibody" as used herein refers to antibodies having variable and constant regions corresponding substantially to, or derived from, antibodies obtained from human subjects. The term "chimeric antibodies" as used herein, refers to recombinant or genetically engineered antibodies, such as for example mouse monoclonal antibodies, which contain polypeptides or domains from a different species, for example human, introduced to reduce the antibodies' immunogenicity. The term "humanized antibodies" refers to antibodies from non-human species whose protein sequences have been modified to increase their similarity to antibody variants produced naturally in humans, in order to reduce immunogenicity.

It may be beneficial for a complex as defined herein to, in addition to being capable of binding IL-6, target at least one additional antigen. In one embodiment, said additional antigen is associated with a disease or disorder of the immune system. In another embodiment, said additional antigen is associated with cancer. Thus, in one embodiment there is provided a complex as defined herein, wherein said antibody or antigen binding fragment thereof has affinity for an additional antigen, for example associated with a disease or disorder of the immune system, or associated with cancer. Non-limiting examples include antigens associated with an IL-6 related disorder of the immune system, as well as antigens associated with any other IL-6 related disorder. In one embodiment, the antigen is selected from the group consisting of angiogenin 2 (Ang-2), vascular endothelial growth factor (VEGF), tumor necrosis factors (TNF), tumor necrosis factor ligand super family member 11 (TNFSF11), TNFSF13, TNFSF13B, TNFSF14, TNFSF15, insulin-like growth factor (IGF), interleukin 1α (IL-1α), interleukin 1β (IL-1β), interleukin 10 (IL-10), interleukin 17A (IL-17), interleukin 12 (IL-12), interleukin 23 (IL-23), interleukin 33 (IL-33), granulocyte macrophage colony-stimulating factor (GM-CSF), granulocyte colony-stimulating factor (G-CSF), high-mobility group protein B1 (HMGB1), lipopolysaccharide (LPS), toll-like receptor 4 (TLR4), nerve growth factor (NGF), chemokine C-C motif ligand 19 (CCL19), chemokine C-C motif ligand 21 (CCL21), chemokine C-X-C motif ligand 4 (CXCL4) and interferon alpha.

In one particular embodiment, said antigen is selected from the group consisting of IL-1β, TNF, GM-CSF, G-CSF, IL-12, IL-23, IL-17, HMGB1, LPS and TLR4. In one embodiment, said antigen is a cytokine, for example being selected from the group consisting of IL-16, TNF, GM-CSF, G-CSF, IL-12, IL-23 and IL-17. In one particular embodiment, said antigen is TNF.

In one embodiment, said antibody or fragment thereof is selected from the group consisting of adalimumab, infliximab, golimumab, certolimumab pegol, and antigen binding fragments thereof. In another embodiment said antibody or fragment thereof is a full-length antibody selected from the group consisting of adalimumab, infliximab, golimumab and certolimumab pegol. In one particular embodiment, said antibody or antigen binding fragment thereof is adalimumab or an antigen binding fragment thereof, for example full-length adalimumab.

Other non-limiting examples of additional targets for binding by the complex as defined herein are half-life extending targets. When the complex binds to such a target, the in vivo half-life of the complex is extended. In one particular embodiment, the additional target is albumin. In one embodiment, said albumin binding activity is provided by including the albumin binding domain of streptococcal protein G or a derivative thereof into the complex as defined herein.

Binding of a complex as defined herein to IL-6 may interfere with canonical cis- and/or with trans-signaling via IL-6 in vivo or in vitro. Thus, in one embodiment, there is provided a complex as defined herein which is capable of blocking IL-6 dependent signaling via the cis-signaling pathway. In another embodiment, the complex as defined herein is capable of blocking IL-6 dependent signaling via the trans-signaling pathway. In another embodiment, the complex as defined herein is capable of blocking IL-6 dependent signaling via both the cis-signaling pathway and the trans-signaling pathway.

The half maximal inhibitory concentration (IC50) is a measure of the effectiveness of a substance in inhibiting a specific biological or biochemical function. This quantitative measure indicates how much of a particular substance is needed to inhibit a given biological process by half, and is commonly used in the art. In one particular embodiment, there is provided a complex as defined herein capable of blocking IL-6 signaling such that the half maximal inhibitory concentration (IC50) of the blocking is at most $1\times10^{-6}$ M, such as at most $1\times10^{-7}$ M, such as at most $1\times10^{-8}$ M, such as at most $1\times10^{-9}$ M, such as at most $1\times10^{-10}$ M. This blocking may be of either the cis- or the trans-signaling pathway. In one embodiment, said complex is capable of blocking the interaction of IL-6/IL-6Rα with gp130.

In the following section, TNF is used as an illustrative example of the additional antigen as described above and thus should not be viewed as limiting. Thus, the methods for measuring affinity are equally well suited to measure the affinity of a complex as described herein for any other suitable additional antigen.

The terms "IL-6 binding", "binding affinity for IL-6", "TNF binding" and "binding affinity for TNF", as used herein, refer to a property of a polypeptide or complex as defined herein which may be tested for example by ELISA or the use of surface plasmon resonance (SPR) technology. For example as described in the examples below, binding affinity may be tested in an experiment in which samples of the polypeptide are captured on antibody-coated ELISA plates and biotinylated IL-6 (or biotinylated TNF) is added, followed by streptavidin conjugated HRP. TMB substrate is added and the absorbance at 450 nm is measured using a multi-well plate reader, such as Victor³ (Perkin Elmer). The skilled person may then interpret the results obtained by such experiments to establish at least a qualitative measure of the binding affinity of the complex for IL-6 (or TNF). If a quantitative measure is desired, for example to determine the EC50 value (the half maximal effective concentration) for the interaction, ELISA may also be used. The response of the polypeptide against a dilution series of biotinylated IL-6 (or biotinylated TNF) is measured using ELISA as described above. The skilled person may then interpret the results obtained by such experiments and EC50 values may be calculated from the results using for example GraphPad Prism 5 and non-linear regression.

The IL-6 binding affinity or affinity for an additional antigen, such as TNF, may also be tested in a surface plasmon resonance (SPR) experiment. The IL-6 (or TNF), or a fragment thereof, is immobilized on a sensor chip of a surface plasmon resonance (SPR) instrument, and the sample containing the complex to be tested is passed over the chip. Alternatively, the complex to be tested is immobilized on a sensor chip of the instrument, and a sample containing IL-6 (or TNF), or a fragment thereof, is passed over the chip. The skilled person may then interpret the results obtained by such experiments to establish at least a qualitative measure of the binding affinity of the complex for IL-6 (or TNF). If a quantitative measure is desired, for example to determine a $K_D$ value for the interaction, surface plasmon resonance methods may also be used. Binding values may for example be defined in a Biacore (GE Healthcare) or ProteOn XPR 36 (Bio-Rad) instrument. IL-6 (or TNF) is suitably immobilized on a sensor chip of the instrument, and samples of the complex whose affinity is to be determined are prepared by serial dilution and injected in random order. $K_D$ values may then be calculated from the results using for example the 1:1 Langmuir binding model of the BIAevaluation 4.1 software, or other suitable software, provided by the instrument manufacturer.

With regard to the complex defined herein, in one embodiment, it is capable of binding to IL-6 such that the EC50 value of the interaction is at most $1 \times 10^{-7}$ M, such as at most $1 \times 10^{-8}$ M, such as at most $1 \times 10^{-9}$ M, such as at most $1 \times 10^{-10}$ M.

In one embodiment, the complex is capable of binding to IL-6 such that the $K_D$ value of the interaction is at most $1 \times 10^{-8}$ M, such as at most $1 \times 10^{-9}$ M, such as at most $1 \times 10^{-10}$ M, such as at most $1 \times 10^{-11}$ M.

Binding of a complex as defined herein to an additional antigen may interfere with a signaling pathway involving said antigen in vivo or in vitro. For example, when said additional antigen is TNF, binding of said complex to TNF may interfere with TNF signaling in vivo or in vitro. Thus, in one embodiment, there is provided a complex as defined herein which is capable of blocking TNF dependent signaling. In one particular embodiment, there is provided a complex as defined herein capable of blocking TNF signaling such that the half maximal inhibitory concentration (IC50) of the blocking is at most $1 \times 10^{-7}$ M, such as at most $1 \times 10^{-8}$ M, such as at most $1 \times 10^{-9}$ M, such as at most $1 \times 10^{-10}$ M, such as at most $1 \times 10^{-11}$ M.

In one embodiment, the complex is capable of binding to TNF such that the $K_D$ value of the interaction is at most $1 \times 10^{-7}$ M, such as at most $1 \times 10^{-8}$ M, such as at most $1 \times 10^{-9}$ M, such as at most $1 \times 10^{-10}$ M, such as at most $1 \times 10^{-11}$ M, such as at most $1 \times 10^{-12}$ M.

The complex as described herein may for example be present in the form of a fusion protein or a conjugate. Thus, said at least one IL-6 binding polypeptides and said at least one antibody, or antigen binding fragment thereof, may be coupled by means of chemical conjugation (using known organic chemistry methods) or by any other means, such as expression of the complex as a fusion protein or joined in any other fashion, either directly or via a linker, for example an amino acid linker.

Thus in one embodiment, there is provided a complex as defined herein, wherein said complex is a fusion protein or a conjugate. In one embodiment, said complex is a fusion protein. In another embodiment, said complex is a conjugate. In one embodiment of said complex, said IL-6 binding polypeptide is attached to the N-terminus or C-terminus of the heavy chain of said antibody or antigen binding fragment thereof. In another embodiment, said IL-6 binding polypeptide is attached to the N-terminus or C-terminus of the light chain of said antibody or antigen binding fragment thereof. In one embodiment, said IL-6 binding polypeptide is attached to the N-terminus and/or C-terminus of the light chain and heavy chain of said antibody or antigen binding fragment thereof. For example, the IL-6 binding polypeptide may be attached to only the N-terminus of the heavy chain(s), only the N-terminus of the light chain(s), only the C-terminus of the heavy chain(s), only the C-terminus of the light chain(s), both the N-terminus and the C-terminus of the heavy chain(s), both the N-terminus and the C-terminus of the light chain(s), only the C-terminus of the light chain(s) and the N-terminus of the heavy chain(s), only the C-terminus of the heavy chain(s) and the N-terminus of the light chain(s), of said antibody or antigen binding fragment thereof.

The skilled person is aware that the construction of a fusion protein often involves the use of linkers between the functional moieties to be fused, and there are different kinds of linkers with different properties, such as flexible amino acid linkers, rigid amino acid linkers and cleavable amino acid linkers. Linkers have been used to for example increase stability or improve folding of fusion proteins, to increase expression, improve biological activity, enable targeting and alter pharmacokinetics of fusion proteins. Thus, in one embodiment, said complex further comprising at least one linker, such as at least one linker selected from flexible amino acid linkers, rigid amino acid linkers and cleavable amino acid linkers. In one embodiment, said linker is arranged between said IL-6 binding polypeptide and said antibody or antigen binding fragment thereof.

Flexible linkers are often used in the art when the joined domains require a certain degree of movement or interaction, and may be particularly useful in some embodiments of the complex. Such linkers are generally composed of small, non-polar (for example G) or polar (for example S or T) amino acids. Some flexible linkers primarily consist of stretches of G and S residues, for example (GGGGS; SEQ ID NO:1591)$_p$. Adjusting the copy number "p" allows for optimization of linker in order to achieve appropriate separation between the functional moieties or to maintain necessary inter-moiety interaction. Apart from G and S linkers, other flexible linkers are known in the art, such as G and S linkers containing additional amino acid residues, such as T and A, to maintain flexibility, as well as polar amino acid residues to improve solubility. Examples of flexible linkers that are contemplated for use in the complex described herein also include KESGSVSSEQLAQFRSLD (SEQ ID NO:1592), EGKSSGSGSEKST (SEQ ID NO:1593) and GSAGSAAGSGEF (SEQ ID NO:1594).

Thus in one embodiment, said linker is a flexible linker comprising glycine (G), serine (S) and/or threonine (T) residues. In one embodiment, said linker has a general formula selected from $(G_n S_m)_p$ and $(S_m G_n)_p$, wherein, independently, n=1-7, m=0-7, n+m 8 and p=1-7. In one embodiment, n=1-5. In one embodiment, m=0-5. In one embodiment, p=1-5. In a more specific embodiment, n=4, m=1 and p=1-4. In an even more specific embodiment, said linker is (GGGGS)$_3$ (SEQ ID NO:1595). In another specific embodiment, said linker is GGGGS (SEQ ID NO:1591). In another specific embodiment, said linker is VDGS (SEQ ID NO:1596). In another specific embodiment, said linker is ASGS (SEQ ID NO:1597).

In further aspects of the present disclosure, there is provided a polynucleotide encoding a complex as described herein; an expression vector comprising said polynucleotide; and a host cell comprising said expression vector.

Also encompassed by this disclosure is a method of producing a complex as described above, comprising culturing said host cell under conditions permissive of expression of said polypeptide from its expression vector, and isolating the polypeptide.

The complex of the present disclosure, or any one or more of its sub-component, polypeptide parts, e.g. an IL-6 binding polypeptide or an antigen binding fragment of an antibody, may alternatively be produced by non-biological peptide synthesis using amino acids and/or amino acid derivatives having protected reactive side-chains, the non-biological peptide synthesis comprising step-wise coupling of the amino acids and/or the amino acid derivatives to form a polypeptide according to the first aspect having protected reactive side-chains,
removal of the protecting groups from the reactive side-chains of the polypeptide, and
folding of the polypeptide in aqueous solution.

Said complex may also be produced by the conjugation of at least one IL-6 binding polypeptide to at least one antibody or antigen binding fragment thereof as described herein. The skilled person is aware of conjugation methods known in the art, such as conventional chemical conjugation methods for example using charged succinimidyl esters or carbodiimides.

It should be understood that the complex as disclosed according to the present disclosure may be useful as a therapeutic agent for at least inhibiting IL-6 signaling. Said complex may furthermore be useful for an inhibiting signaling of an additional pathway, through an affinity of said antibody or antigen binding fragment thereof for an additional antigen which is a component of said additional signaling pathway. For example, said antibody or antigen binding fragment thereof may have affinity for TNF.

In another aspect, there is provided a composition comprising a complex as described herein and at least one pharmaceutically acceptable excipient or carrier.

In one embodiment, said composition further comprises at least one additional active agent, such as at least two additional active agents, such as at least three additional active agents. Non-limiting examples of additional active agents that may prove useful in such a composition are immune response modifying agents and anti-cancer agents.

Non limiting examples of immune response modifying agents that can be used as additional active agent in embodiments of the composition according to this aspect include immunosuppressive and immunomodulating agents, and other anti-inflammatory agents. For example, the complex as described herein may be used in combination with an agent selected from the group consisting of disease-modifying antirheumatic drugs (DMARDs), such as gold salts, azathioprine, methotrexate and leflunomide; calcineurin inhibitors, such as cyclosporin A or FK 506; modulators of lymphocyte recirculation; mTOR inhibitors, such as rapamycin; an ascomycin having immuno-suppressive properties; glucocorticoids; corticosteroids; cyclophosphamide; immunosuppressive monoclonal antibodies; adhesion molecule inhibitors, such as LFA-1 antagonists, ICAM-1 or -3 antagonists, VCAM-4 antagonists or VLA-4 antagonists; anti-TNF agents, such as etanercept or monoclonal antibodies to TNF, for example infliximab, adalimumab, golimumab and certolizumab pegol; blockers of proinflammatory cytokines; IL-1 blockers such as anakinra or IL-1 trap; IL-17 blockers; chemokine blockers; non steroidal anti-inflammatory drugs (NSAIDs) such as aspirin; and anti-infectious agents and other immune response modulating agents, as well as combinations thereof.

Non-limiting examples of anti-cancer agents that can be used as additional active agent in embodiments of the composition according to this aspect include agents selected from the group consisting of auristatin, anthracycline, calicheamycin, combretastatin, doxorubicin, duocarmycin, the CC-1065 anti-tumor antibiotic, ecteinsascidin, geldanamycin, maytansinoid, methotrexate, mycotoxin, taxol, ricin, bouganin, gelonin, pseudomonas exotoxin 38 (PE38), diphtheria toxin (DT), and their analogues, and derivates thereof and combinations thereof. A skilled person would appreciate that the non-limiting examples of cytotoxic agents include all possible variant of said agents, for example the agent auristatin includes for example auristatin E, auristatin F, auristatin PE, and derivates thereof.

The skilled person will appreciate that the complex as described herein or a pharmaceutical composition comprising said complex may be administered to a subject using standard administration techniques, such as including oral, topical, intravenous, intraperitoneal, subcutaneous, pulmonary, transdermal, intramuscular, intranasal, buccal, sublingual or suppository administration. Thus, in one embodiment there is provided a complex or pharmaceutical composition as described herein for oral, topical, intravenous, intraperitoneal, subcutaneous, pulmonary, transdermal, intramuscular, intranasal, buccal, sublingual or suppository administration.

Hence, in another aspect of the present disclosure, there is provided a complex or composition as described herein for use as a medicament. In one embodiment, said complex or composition modulates IL-6 function and the function of an additional antigen. Said additional antigen may be associated with a disease or disorder of the immune system in vivo, or associated with cancer. In one embodiment, there is provided a complex described herein, for use as a medicament to modulate IL-6 function in vivo. In one embodiment, said complex or composition is provided for use as a medicament to modulate IL-6 function and the function of an additional antigen, for example an additional antigen associated with a disease or disorder of the immune system in vivo, or associated with cancer. In one particular embodiment, said complex or composition is provided for use as a medicament to modulate IL-6 function and TNF function in vivo.

As used herein, the term "modulate" refers to changing the activity, such as rendering IL-6 function or the function of the additional antigen hypomorph, partially inhibiting or fully inhibiting IL-6 function or the function of the additional antigen.

As used herein, the term "IL-6 related disorder" refers to any disorder, disease or condition in which IL-6 plays a regulatory role in the signaling pathway. As used herein, the term "TNF related disorder" refers to any disorder, disease or condition in which TNF plays a regulatory role in the signaling pathway involved in the disease or disorder.

In one embodiment, there is provided a complex or composition as described herein for use in the treatment of an IL-6 related disorder, such as a disorder related to IL-6 and TNF.

A non-limiting list of IL-6 related disorders, for the treatment of which the complex or composition as described herein may be useful, include inflammatory disease, autoimmune disease, infectious disease, cancer, neoplastic disease, diabetes, neurological disease depression, rheumatoid arthritis (RA), juvenile RA, juvenile idiopathic arthritis, systemic juvenile idiopathic arthritis, vasculitis, psoriatic arthritis, psoriasis, ankylosing spondylitis, chronic inflammatory bowel disease such as Crohn's disease or ulcerative colitis, Grave's disease, Behçet's disease, uveitis, giant cell arteritis, multiple sclerosis (MS), systemic sclerosis, systemic lupus erythematosus (SLE), polymyositis, polymyalgia rheumatic, asthma, chronic obstructive pulmonary disease (COPD), relapsing polychondritis, pancreatitis, peritonitis, nephritis, Kawasaki's disease, Sjögren's syndrome, adult Still's disease, colitis associated cancer, renal cancer, kidney cancer, prostate cancer, malignant lymphoma, multiple myeloma, Castleman's disease, breast cancer, lung cancer, Alzheimer's disease, HIV, diabetes, sepsis, cachexia, myelodysplastic syndrome (MDS), liver cirrhosis, graft versus host disease, myocardial infarction, endometriosis and osteoporosis.

It is known in the art that treatment with anti-TNF agents is useful for treating amongst other ankylosing spondylitis, psoriatic arthritis, rheumatoid arthritis, juvenile idiopathic arthritis, plaque psoriasis, Crohn's disease and ulcerative colitis. Additionally, data from off-label use of anti-TNF agents indicate that TNF inhibition may result in rapid control of the inflammatory process in certain cases, such as Behçet's disease, non-infectious ocular inflammation, *hidradenitis suppurativa* and *pyoderma gangrenosum*. Additionally, there are ongoing clinical trials relating to the use of anti-TNF agents in the treatment of treatment-resistant major depression, Alzheimer's disease, *pemphigus vulgaris*, cutaneous manifestations of sarcoidosis, toxic epidermal necrolysis, *lichen planus*, inclusion body myositis and Kawasaki disease. (Karampetsou et al, 2010, International Journal of Medicine, Volume 103, No 12. 917-928). Thus, a non-limiting list of TNF related disorders, for the treatment of which the complex or composition as described herein may be useful in those embodiments where the additional antigen is TNF, include inflammatory disease, autoimmune disease, infectious disease, ankylosing spondylitis, psoriatic arthritis, rheumatoid arthritis, juvenile idiopathic arthritis, plaque psoriasis, chronic inflammatory bowel disease such as Crohn's disease or ulcerative colitis, Behçet's disease, non-infectious ocular inflammation, *hidradenitis suppurativa, pyoderma gangrenosum*, depression, Alzheimer's disease, *pemphigus vulgaris*, cutaneous manifestations of sarcoidosis, toxic epidermal necrolysis, *lichen planus*, inclusion body myositis and Kawasaki disease.

In one embodiment, said disorder is selected from the group consisting of ankylosing spondylitis, psoriatic arthritis, Crohn's disease, ulcerative colitis, rheumatoid arthritis, juvenile idiopathic arthritis and plaque psoriasis, such as the group consisting of ankylosing spondylitis, psoriatic arthritis, Crohn's disease, ulcerative colitis, rheumatoid arthritis and plaque psoriasis, such as the group consisting of ankylosing spondylitis, psoriatic arthritis, Crohn's disease, rheumatoid arthritis, juvenile idiopathic arthritis and plaque psoriasis, such as the group consisting of ankylosing spondylitis, psoriatic arthritis, Crohn's disease and rheumatoid arthritis, such as the group consisting of ankylosing spondylitis, psoriatic arthritis and rheumatoid arthritis.

In one particular embodiment, said disorder is selected from the group consisting of rheumatoid arthritis (RA), juvenile RA, juvenile idiopathic arthritis or systemic juvenile idiopathic arthritis. In a specific embodiment, said disorder is rheumatoid arthritis (RA).

In another particular embodiment, said disorder is chronic inflammatory bowel disease, such as Crohn's disease or ulcerative colitis.

In another embodiment, said disorder is cancer or neoplastic disease, such as a cancer or neoplastic disease selected from the group consisting of colitis associated cancer, renal cancer, kidney cancer, prostate cancer, malignant lymphoma, multiple myeloma, Castleman's disease, breast cancer and lung cancer.

In another embodiment, said disorder is selected from the group consisting of Alzheimer's disease, HIV, diabetes, sepsis, cachexia, myelodysplastic syndrome (MDS), liver cirrhosis, graft versus host disease, myocardial infarction, endometriosis and osteoporosis.

In a related aspect, there is provided a method of treatment of an IL-6 related disorder, comprising administering to a subject in need thereof an effective amount of a complex or composition as described herein. In a more specific embodiment of said method, the complex or composition as described herein modulates IL-6 function in vivo. In one embodiment, said complex or composition modulates IL-6 function and the function of an additional antigen, for example an antigen associated with a disease or disorder of the immune system in vivo, or an antigen associated with cancer. In one particular embodiment wherein said additional antigen is TNF, said complex or composition modulates IL-6 function and TNF function in vivo.

Embodiments relating to specific disorders and disclosed in the context of the aspect relating to the complex or composition as described herein for use in treatment, are equally relevant for the present aspect of a method of treatment. For the sake of brevity, the listings of disorders will not be repeated here.

It may be beneficial to administer a therapeutically effective amount of a complex or composition as described herein and at least one second drug substance, such as an immune response modulating agent as described above or an anti-cancer agent.

As used herein, the term "co-administration" encompasses both concomitant and sequential administration. Thus, in one embodiment there is provided a method as defined above further comprising co-administration of an immune response modulating agent as described above. In another embodiment there is provided a method as defined above further comprising co-administration of an anti-cancer agent as described above.

While the invention has been described with reference to various exemplary aspects and embodiments, it will be understood by those skilled in the art that various changes may be made and equivalents may be substituted for elements thereof without departing from the scope of the invention. In addition, many modifications may be made to adapt a particular situation or molecule to the teachings of the invention without departing from the essential scope thereof. Therefore, it is intended that the invention not be limited to any particular embodiment contemplated, but that the invention will include all embodiments falling within the scope of the appended claims.

BRIEF DESCRIPTION OF THE FIGURES

FIG. 1A-VV is a listing of amino acid sequences of examples of IL-6 binding Z variant polypeptides (SEQ ID NO:1-1551), control Z variant polypeptides (SEQ ID NO:1552-1553), the albumin binding domain (ABD) variant PP013 (SEQ ID NO:1554), human IL-6 (SEQ ID NO:1555) and murine IL-6 (SEQ ID NO:1556) used for selection, screening and/or characterization, two different heavy chain sequences ($HC_{Ada}$ and $HC2_{Ada}$; SEQ ID NO:1557 and 1559) and one light chain sequence ($LC_{Ada}$; SEQ ID NO:1558) of TNF binding monoclonal antibodies Ada and Ada2. In the IL-6 binding polypeptides, the deduced IL-6 binding motifs (BM) extend from position 8 to position 36 in each sequence. The amino acid sequences of the 49 amino acid residues long polypeptides predicted to constitute the complete three-helix bundle within each of these Z variants (BMod) extend from position 7 to position 55.

FIG. 13 shows binding of the indicated complexes to A) TNF and B) IL-6 analyzed by ELISA as described in Example 13. The TNF-binding antibody adalimumab and a non-relevant IgG were included as controls in both assays.

EXAMPLES

Summary

Figure 2:
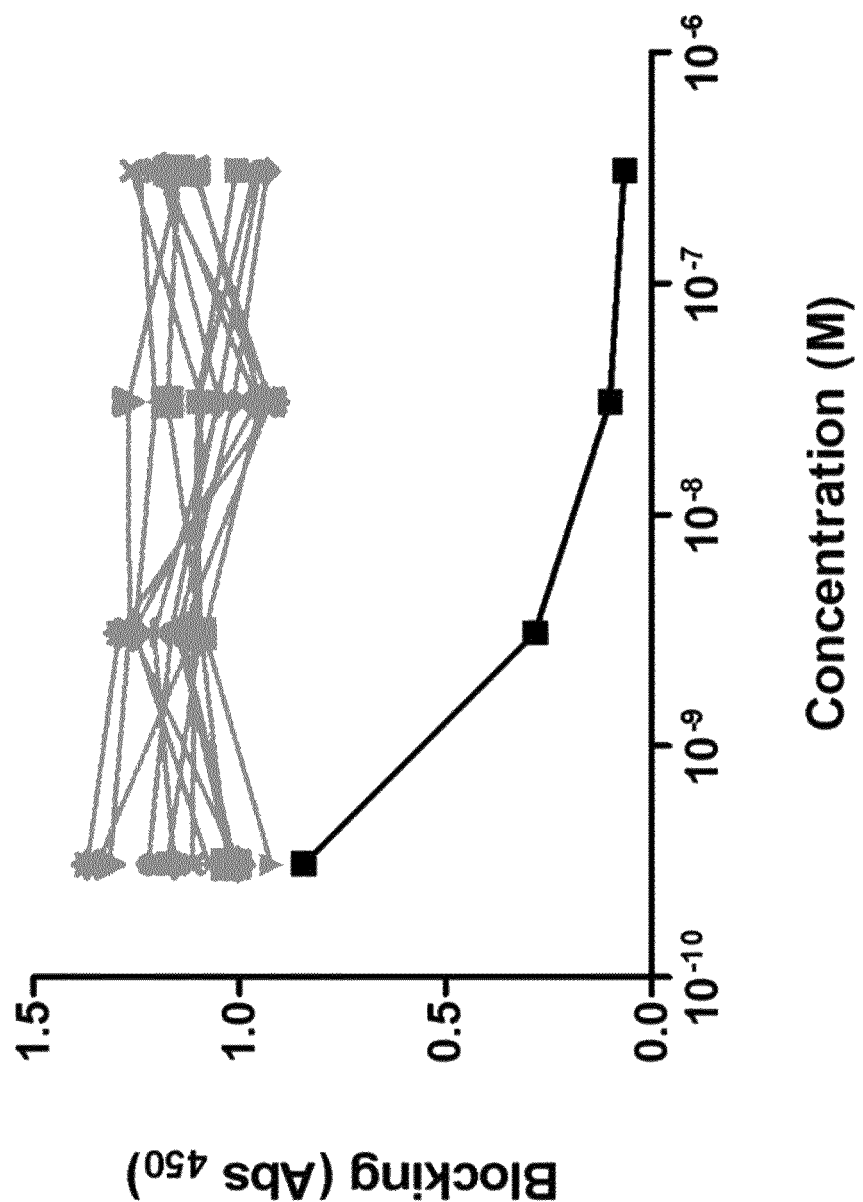
FIG. 2 shows the result of blocking of the interaction between hIL-6 and hIL-6Rα, assayed as described in Example 2. In contrast to the hIL-6Rα binding antibody tocilizumab (black), which was included for comparison, the tested IL-6 binding Z variants (gray) did not interfere with the binding of hIL-6 to its receptor hIL-6Rα.

In inflammatory rheumatic diseases, competitive blocking of IL-6 induced effects has shown to be highly effective. Similarly, the high affinity anti-human TNF monoclonal antibody adalimumab is used clinically for treatment of TNF-induced inflammation indications, including rheumatoid arthritis. To investigate if these two anti-inflammatory effects could be combined in one molecule, different fusion molecules based on an IL-6 targeting Z variant and an antibody, "Ada", having the same binding specificity as the TNF targeting antibody adalimumab, were designed, produced and characterized in vitro and in vivo, as described in the following Examples.

Examples 1-8 disclose the development of novel Z variant molecules targeting interleukin 6 (IL-6). The Z variants were obtained using phage display technology using a phage library of Z variants, a first maturated library of IL-6 binding Z variants and a second maturated library of IL-6 binding Z variants as described below. The genes encoding IL-6 binding polypeptides described herein were sequenced and the corresponding amino acid sequences are listed in FIG. 1A-UU and are denoted by the identifiers SEQ ID NO: 1-1551. Said IL-6 binding polypeptides were produced and characterized in vitro and in vivo.

Examples 9-13 disclose fusion of selected IL-6 binding Z variants to an anti-TNF monoclonal antibody in order to study the inflammation blocking effects of a complex comprising an IL-6 binding polypeptide and said antibody within the same molecule. Fusions based on an IL-6 targeting Z variant and the TNF targeting monoclonal antibody were designed, produced and characterized in vitro and in vivo.

Example 1

Selection and ELISA Screening of IL-6 Binding Z Variants

In this Example, human (hIL-6) and murine IL-6 (mIL-6) were used as target proteins in phage display selections using a phage library of Z variants. The DNA of selected clones was sequenced and the clones were produced in *E. coli* periplasmic fractions and assayed against IL-6 in ELISA (enzyme-linked immunosorbent assay).

Materials and Methods

Biotinylation of the Target Proteins Human and Murine IL-6:

hIL-6 and mIL-6 (Peprotech, cat. no. 200-06 and 216-16, respectively) were biotinylated using No-Weigh EZ-Link Sulfo-NHS-LC-Biotin (Thermo Scientific, cat. no. 21327) at a 12×molar excess according to the manufacturer's recommendations. The reactions were performed at room temperature (RT) for 30 min. Next, buffer exchange to phosphate buffered saline (PBS, 10 mM phosphate, 137 mM NaCl, 2.68 mM KCl, pH 7.4) was performed using Slide-a-lyzer dialysis cassettes (Thermo Scientific, cat. no. 66333, 3,500 MWCO) according to the manufacturer's instructions.

Phage Display Selection of IL-6 Binding Z Variants:

A library of random variants of protein Z displayed on bacteriophage, constructed in phagemid pAY02592 essentially as described in Grönwall et al. (2007) J Biotechnol, 128:162-183, was used to select IL-6 binding Z variants. In this library, an albumin binding domain (abbreviated ABD and corresponding to GA3 of protein G from *Streptococcus* strain G148) was used as fusion partner to the Z variants. The library is denoted Zlib006Naive.II and has a size of $1.5 \times 10^{10}$ library members (Z variants). *E. coli* RRIΔM15 cells (Ruther et al., (1982) Nucleic Acids Res 10:5765-5772) from a glycerol stock containing the phagemid library Zlib006Naive.II were inoculated in 20 l of a defined proline free medium [7 g/l dipotassium hydrogenphosphate, 1 g/l trisodium citrate dihydrate, 0.02 g/l uracil, 6.7 g/l YNB (Difco™ Yeast Nitrogen Base w/o amino acids, Becton Dickinson), 5.5 g/l glucose monohydrate, 0.3 g/l L-alanine, 0.24 g/l L-arginine monohydrochloride, 0.11 g/l L-asparagine monohydrate, 0.1 g/l L-cysteine, 0.3 g/l L-glutamic acid, 0.1 g/l L-glutamine, 0.2 g/l glycine, 0.05 g/l L-histidine, 0.1 g/l L-isoleucine, 0.1 g/l L-leucine, 0.25 g/l L-lysine monohydrochloride, 0.1 g/l L-methionine, 0.2 g/l L-phenylalanine, 0.3 g/l L-serine, 0.2 g/l L-threonine, 0.1 g/l L-tryptophane, 0.05 g/l L-tyrosine, 0.1 g/l L-valine], supplemented with 100 μg/ml ampicillin. The cultivations were grown at 37° C. in a fermenter (Belach Bioteknik, BR20). When the cells reached an optical density at 600 nm ($OD_{600}$) of 0.75, approximately 2.6 l of the cultivation was infected using a 10× molar excess of M13K07 helper phage (New England Biolabs, cat. no. N0315S). The cells were incubated for 30 min, whereupon the fermenter was filled up to 20 l with TSB-YE (Tryptic Soy Broth-Yeast Extract; 30 g/l TSB, 5 g/l yeast extract) supplemented with 100 μM isopropyl-6-D-1-thiogalactopyranoside (IPTG) for induction of expression and with 25 μg/ml kanamycin and 12.5 μg/ml carbenicillin. Cells were grown at 30° C. for 22 h and the cells in the cultivation were pelleted by centrifugation at 15,900 g. Phage particles were precipitated from the supernatant twice in PEG/NaCl (polyethylene glycol/sodium chloride), filtered and dissolved in PBS and glycerol as described in Grönwall et al., supra. Phage stocks were stored at −80° C. before use.

Selection procedure and phage stock preparation were performed essentially as described for selection against another biotinylated target in WO2009/077175. In order to reduce the amount of background binders, pre-selection was performed by incubation of phage stock with SA-beads for 30 min at RT. All tubes and beads used in the selection were pre-blocked with PBS supplemented with 5% BSA. Selection was performed in PBS supplemented with 3% BSA and 0.1% Tween20 during 2 h at RT, followed by capture of target-bound phage on DYNABEADS M-280 Streptavidin (SA-beads, Invitrogen, cat. no. 11206D) using 1 mg beads per 1.6 μg biotinylated hIL-6 or mIL-6. *E. coli* strain XL1-Blue (Agilent technologies, cat. no. 200268) was used for phage amplification.

Selections against biotinylated hIL-6 and mIL-6 were performed in four cycles divided in four different final tracks: track (1) in cycle 1 was divided either in the second cycle or the fourth cycle, resulting in totally three tracks (1-1 to 1-3) in cycle 2, three tracks (1-1-1 to 1-3-1) in cycle 3 and four tracks (1-1-1-1 to 1-3-1-2) in cycle 4. After washes, bound phage were eluted from the selection tracks using 500 μl 0.1 M glycine-HCl, pH 2.2, followed by immediate neutralization with 50 μl 1 M Tris-HCl, pH 8.0, and 450 μl PBS. An overview of the selection strategy and parameters used, describing the differences in the selection tracks in terms of lowered target concentration and increased number of washes, is shown in Table 2.

TABLE 2

Overview of the strategy for primary selection

| Cycle | Selection track | Phage stock from library or selection track | Target | Target concentration (nM) | Number of washes |
|---|---|---|---|---|---|
| 1 | 1 | Zlib006Naive.II | hIL-6 | 100 | 2 |
| 2 | 1-1 | 1 | hIL-6 | 50 | 5 |
| 2 | 1-2 | 1 | hIL-6 | 10 | 5 |
| 2 | 1-3 | 1 | mIL-6 | 100 | 4 |
| 3 | 1-1-1 | 1-1 | hIL-6 | 25 | 6 |
| 3 | 1-2-1 | 1-2 | hIL-6 | 2 | 8 |
| 3 | 1-3-1 | 1-3 | hIL-6 | 25 | 6 |
| 4 | 1-1-1-1 | 1-1-1 | hIL-6 | 10 | 8 |
| 4 | 1-2-1-1 | 1-2-1 | hIL-6 | 0.5 | 12 |
| 4 | 1-3-1-1 | 1-3-1 | mIL-6 | 10 | 8 |
| 4 | 1-3-1-2 | 1-3-1 | hIL-6 | 0.5 | 12 |

Sequencing:

PCR fragments were amplified from single colonies using a standard PCR program and the primers AFFI-21 (5'-tgcttccggctcgtatgttgtgtg; SEQ ID NO:1560) and AFFI-22 (5'-cggaaccagagccaccaccgg; SEQ ID NO:1561). Sequencing of amplified fragments was performed using the biotinylated oligonucleotide AFFI-72 (5'-biotin-cggaaccagagccaccaccgg; SEQ ID NO:1562) and a BIGDYE Terminator v3.1 Cycle Sequencing Kit (Applied Biosystems), used in accordance with the manufacturer's recommendations. The sequencing reactions were purified by binding to magnetic streptavidin coated beads (Detach Streptavidin Beads, Nordiag, cat. no. 2012-01) using a Magnatrix 8000 (Magnetic Biosolution) instrument and analyzed on an ABI PRISM® 3130xl Genetic Analyzer (PE Applied Biosystems).

Production of Z Variants for ELISA:

Sequenced Z variants were produced by inoculating single colonies from the selections in 1 ml TSB-YE medium supplemented with 100 μg/ml ampicillin and 0.1 mM IPTG in deep-well plates (Nunc, cat. no. 278752). The plates were incubated for 24 h at 37° C. Cells were pelleted by centrifugation, re-suspended in 200 μl PBST 0.05% (PBS supplemented with 0.05% Tween-20), frozen at −80° C. and thawed in a water bath to release the periplasmic fraction of the cells. The freeze-thawing procedure was repeated five times. The samples were diluted with PBST 0.05% to a total of 800 μl and cells were pelleted by centrifugation. The supernatant of the periplasmic extract contained the Z variants as fusions to ABD, expressed as AQHDEALE-[Z #####]-VDYV-[ABD]-YVPG (SEQ ID NO:1600) (Grönwall et al., supra). Z ##### refers to individual, 58 amino acid residue Z variants.

ELISA Analysis of Z Variants:

The binding of Z variants to IL-6 was analyzed in an ELISA assay. Half-area 96-well ELISA plates (Costar, cat. no. 3690) were coated at 4° C. overnight with 2 μg/ml of an anti-ABD goat antibody (produced in-house) diluted in coating buffer (50 mM sodium carbonate, pH 9.6; Sigma, cat. no. C3041). The antibody solution was poured off and the wells were blocked with 100 μl of PBSC (PBS supplemented with 0.5% casein; Sigma, cat. no. C8654) for 1.5 h at RT. The blocking solution was discarded and 50 μl periplasmic solution was added to the wells and incubated for 1.5 h at RT under slow shaking. The supernatants were poured off and the wells were washed 4 times with PBST 0.05%. Next, 50 μl of biotinylated hIL-6 at a concentration of 7.7 nM in PBSC was added to each well. The plates were incubated for 1.5 h at RT followed by washes as described above. Streptavidin conjugated HRP (Thermo Scientific, cat. no. N100) was diluted 1:30 000 in PBSC and added to the wells followed by 45 min incubation. After washing as described above, 50 μl ImmunoPure TMB substrate (Thermo Scientific, cat. no. 34021) was added to the wells and the plates were treated according to the manufacturer's recommendations. A Z variant binding a specific irrelevant protein was used as a positive control by assaying against that specific irrelevant protein, and as a negative control by assaying against hIL-6. As blank control, PBST 0.05% was added instead of the periplasmic sample. Absorbance was measured at 450 nm using a multi-well plate reader (Victor$^3$, Perkin Elmer).

Results

Phage Display Selection of IL-6 Binding Z Variants:

Individual clones were prepared after four cycles of phage display selections against biotinylated hIL-6 and mIL-6.

Sequencing:

Sequencing was performed for clones picked at random from selection round four. Each Z variant was given a unique identification number #####, and individual variants are referred to as Z #####. The amino acid sequences of 58 residues long Z variants are listed in FIG. 1 and in the sequence listing as SEQ ID NO:1503-1551. The deduced IL-6 binding motifs (BM) extend from position 8 to position 36 in each sequence. The amino acid sequences of the 49 amino acid residues long polypeptides predicted to constitute the complete three-helix bundle within each of these Z variants (BMod) extend from position 7 to position 55.

ELISA Analysis of Z Variants:

The clones obtained after four cycles of selection were produced in 96-well plates and screened for hIL-6 binding activity in ELISA. All clones giving a response with signals corresponding to at least 3× the negative control were considered as positive IL-6 binders. The control molecule specific for an irrelevant protein gave a positive signal for the specific protein, whereas no signal was obtained against hIL-6.

Example 2

Production and In Vitro Characterization of IL-6 Binding Z Variants

In this Example, a subset of Z variants were subcloned, produced and functionally assessed in competition ELISAs and cell assays. Two different ELISA assays were applied to investigate if the IL-6 binding Z variants were able to block the specific interaction between IL-6 and IL-6Rα or between IL-6 and the gp130 receptor, respectively. The potency of the Z variant polypeptides was assessed using two different cell assays, mimicking the classical cis-signaling pathway and trans-signaling pathway, respectively. Finally, circular dichroism (CD) spectroscopy was performed for a subset of the Z variants in order to investigate their secondary structure and determine their melting temperatures, Tm.

Materials and Methods

Subcloning of Z Variants:

The DNA of 13 IL-6 binding Z variants, Z06777 (SEQ ID NO:1503), Z06779 (SEQ ID NO:1504), Z06789 (SEQ ID NO:1505), Z06791 (SEQ ID NO:1506), Z06792 (SEQ ID NO:1507), Z06799 (SEQ ID NO:1508), Z06802 (SEQ ID NO:1509), Z06805 (SEQ ID NO:1510), Z06809 (SEQ ID NO:1511), Z06814 (SEQ ID NO:1512), Z06829 (SEQ ID NO:1513), Z06834 (SEQ ID NO:1514), Z06844 (SEQ ID NO:1515) was amplified from the library vector pAY02592. A subcloning strategy for construction of monomeric Z variant molecules with an N-terminal His$_6$ tag was applied using standard molecular biology techniques (essentially as described in WO2009/077175 for Z variants binding another target). The Z gene fragments were subcloned into the expression vector pAY01448 resulting in the encoded sequence MGSSHHHHHHLQ-[Z #####]-VD (SEQ ID NO:1598).

A subset of five IL-6 binding Z variants, Z06789, Z06799, Z06809, Z06814 and Z06829, and two control Z variants binding an irrelevant target, Z03638 (SEQ ID NO:1552) and Z04726 (SEQ ID NO:1553), were subcloned in fusion with the ABD variant PP013 (SEQ ID NO:1554). The constructs encoded by the expression vectors were MGSSLQ-[Z #####]-VDGS-PP013 (SEQ ID NO:1599).

Cultivation and Purification:

E. coli BL21(DE3) cells (Novagen) were transformed with plasmids containing the gene fragment of each respective IL-6 binding Z variant and cultivated at 37° C. in 800 or 1000 ml of TSB-YE medium supplemented with 50 μg/ml kanamycin. In order to induce protein expression, IPTG was added to a final concentration of 0.2 mM at $OD_{600}$=2 and the cultivation was incubated at 37° C. for another 5 h. The cells were harvested by centrifugation.

Purification of IL-6 Binding Z Variants with a His$_6$-Tag:

Protein purification was performed under either native or denatured conditions.

The purification under native conditions was performed as follows: Approximately 2-5 g of each cell pellet was resuspended in 10 ml PBS. After cell disruption by sonication, cell debris was removed by centrifugation and each supernatant was applied on 2 ml Talon cobolt columns (Clontech, cat. no. 635504) equilibrated with 20 ml wash buffer (46.6 mM Na$_2$HPO$_4$, 3.4 mM NaH$_2$PO$_4$, and 300 mM NaCl, pH 7.0). Contaminants were removed by washing with wash buffer, and the IL-6 binding Z variants were subsequently eluted with elution buffer (50 mM NaH$_2$PO$_4$, 100 mM NaCl, 30 mM HAc and 70 mM NaAc, pH 5.0).

The purification under denatured conditions was performed as follows: Approximately 2-5 g of each cell pellet was resuspended in 10 ml lysis buffer (7 M guanidinium hydrochloride, 47 mM Na$_2$HPO$_4$, 2.65 mM NaH$_2$PO$_4$, 10 mM Tris-HCl, 104 mM NaCl, pH 8.0) followed by incubation at 37° C., 150 rpm for 2 h. The washing and elution steps were performed as for the native purification but using different buffers (wash buffer: 6 M guanidinium hydrochloride, 47 mM Na$_2$HPO$_4$, 3.4 mM NaH$_2$PO$_4$, 300 mM NaCl, pH 8.0; elution buffer: 6 M urea, 0.1 M NaCl, 29.6 mM HAc, 70.4 mM NaAc and 50 mM NaH$_2$PO$_4$, pH 5.0). Purified Z variants were buffer exchanged to PBS using PD-10 columns (GE Healthcare) according to the manufacturer's protocol.

Protein concentrations were determined by measuring the absorbance at 280 nm, using the extinction coefficient of the respective protein. The purity of the IL-6 binding Z variants was analyzed by SDS-PAGE stained with Coomassie Blue.

Purification of IL-6 Binding Z Variants in Fusion with ABD:

Approximately 2.5 g of each cell pellet was re-suspended in 20 ml TST-buffer (25 mM Tris-HCl, 1 mM EDTA, 200 mM NaCl, 0.05% Tween20, pH 8.0) supplemented with Benzonase® (Merck). After cell disruption by sonication and clarification by centrifugation, each supernatant was applied on a gravity flow column with 1 ml anti-ABD agarose (WO2014/064237). After washing with TST-buffer and 5 mM NH$_4$Ac pH 5.5 buffer, the ABD fused Z variants were eluted with 0.1 M HAc. Buffer exchange to PBS (2.68 mM KCl, 137 mM NaCl, 1.47 mM KH$_2$PO$_4$, 8.1 mM Na$_2$HPO$_4$, pH 7.4) was performed using PD-10 columns (GE Healthcare). Next, the ABD fused Z variants were purified on 1 ml Detoxi-Gel Endotoxin Removing Columns (Pierce, cat. no. 20344) to ensure low endotoxin content. Protein concentrations were determined by measuring the absorbance at 280 nm, using the extinction coefficient of the respective protein. The purity was analyzed by SDS-PAGE stained with Coomassie Blue and the identity of each purified Z-ABD variant was confirmed using LC/MS analysis.

Analysis of Binding Site:

A first assay was employed to evaluate the interference of the IL-6 binding Z variants with the interaction between hIL-6 and the human IL-6Rα (hIL-6Rα). In this experiment, half area 96-well ELISA plates were coated with anti-IL-6R capture antibody (R&D Systems) at a concentration of 2 μg/ml. Plates were incubated overnight at 4° C. and then washed twice in tap water. Next, the plates were blocked for 1 h in PBSC, and hIL-6Rα (R&D Systems) was added at a concentration of 250 ng/ml. Plates were incubated for 1.5 h at RT and then washed 4 times with 200 μl 0.05% Tween/PBS. In separate plates, serial dilutions (concentration range 500-0.5 nM) of the 13 His$_6$-tagged Z variant polypeptides were titrated with 2.5 nM of biotinylated hIL-6. The IL-6Rα antibody tocilizumab (Roche) was prepared in the same way and included for comparison. Each pre-mixture of Z variant with biotinylated hIL-6 was then transferred to wells containing hIL-6Rα. Plates were incubated for another 1.5 h and then washed four times. A 1:8000 dilution of streptavidin-HRP (Thermo Scientific) was added and the plates were incubated for 1 h. Plates were washed a final four times with 0.05% Tween/PBS and TMB substrate (Thermo Scientific) was added for 15 min before the reaction was stopped with 2 M H2504. The absorbance was measured at 450 nm using a microplate reader (Victor$^3$, Perkin Elmer).

A second assay was employed to evaluate the interference of the IL-6 binding Z variants on the interaction between human gp130 (hgp130) and pre-mixed hIL-6/hIL-6Rα. In this experiment, half area 96-well ELISA plates were coated with Fc-fused hgp130 (hgp130-Fc) at a concentration of 4 μg/ml. Plates were incubated overnight at 4° C. and then washed twice in tap water. Next, the plates were blocked for 1 h in PBSC. Plates were incubated for 1.5 h at RT and then washed 4 times with 200 μl 0.05% Tween/PBS. In separate plates, serial dilutions (concentration range 500-0.5 nM) of the 13 His$_6$-tagged Z variant polypeptides were titrated with fixed concentration of hIL-6/hIL-6Rα (0.5 nM and 5 nM, respectively).

The IL-6Rα binding antibody tocilizumab (Roche) was prepared in the same way and included for comparison. The pre-mixed association of each Z variant polypeptide with hIL-6/hIL-6Rα was then transferred to wells containing hgp130. Plates were incubated for 1.5 h and then washed 4 times. A biotinylated anti-IL-6Rα antibody (R&D Systems) was added and the plates were incubated for another 1.5 h followed by washing. A 1:8000 dilution of streptavidin-HRP (Thermo Scientific) was added and the plates were incubated for 1 h. Next, plates were washed four times and TMB substrate (Thermo Scientific) was added for 15 min before the reaction was stopped with 2 M H$_2$SO$_4$. The absorbance was measured at 450 nm using a microplate reader (Victor$^3$, Perkin Elmer).

In Vitro Neutralization Assays:

A first assay, evaluating the classical signaling pathway, used the TF-1 cell line that proliferates in response to human IL-6, TNF and GM-CSF. TF-1 cells were cultured in RPMI1640 with L-glut (Lonza) supplemented with 10% FCS (Gibco), Pen-Strep (Lonza) and 2 ng/ml rhGM-CSF (R&D Systems). Prior to use, cells were washed twice in RPMI1640 in the absence of rhGM-CSF. Cells were then counted and dispensed into 96 well flat bottomed plates at a density of 4×10$^4$ cells per well. In separate plates, serial dilutions of the inhibitory compounds (IL-6 binding Z variants, with a His$_6$-tag (concentration range 1000-0.1 nM) or in fusion with the ABD variant PP013 (SEQ ID NO:1554, concentration range 200-0.007 nM)), and the IL-6Rα binding antibody tocilizumab (Roche; concentration range 200-0.007 nM) were incubated in the presence of 0.099 nM rhIL-6 (R&D Systems, UK). In addition, the ABD-fused variants were incubated with or without 9 μM rhHSA (Novozymes). The pre-mixtures of the Z variant polypeptides and hIL-6 were then transferred to wells containing TF-1 cells which were incubated for 72 h at 37° C. in a humidified 5% CO$_2$ atmosphere. During the last four hours of incubation 10 μl of CCK-8 (Fluke, Sigma Aldrich) was added per well to determine the number of proliferating cells. The absorbance was measured at 450 nm (Abs450) using a microplate reader (Victor$^3$, Perkin Elmer). The data on cell growth was assessed by non-linear regression to a four-parameter dose-response curve, and the half maximal inhibitory concentration (1050) was determined using GraphPadPrism program. The inhibition of IL-6-dependent proliferation of TF-1 cells by the inhibitory molecules was as Abs450 minus control wells that contained cells but no hIL-6.

To address the trans-signaling pathway, a second assay was used. Herein, human umbilical vein endothelial cells (HUVECs) were stimulated with hIL-6 and soluble hIL-6Rα and the readout was the production of monocyte chemoattractant protein-1 (MCP-1). HUVECs (Lonza) were grown in EGM-2 bullet kit media (Lonza) and passaged in culture no more than eight times. Cells were grown until 75% confluence before use. Cells were detached using trypsin/EDTA (Lonza), resuspended and washed once in fresh medium. Next, cells were counted and dispensed into 96 well flat bottom plates at a density of 2×10$^4$ cells per well. Cells were cultured overnight at 37° C. in a humidified 5% CO$_2$ atmosphere. In separate plates, serial dilutions (100-0.0015 nM) of the IL-6 binding Z variants Z06789, Z06799, Z06809, Z06814 and Z06829 in fusion with the ABD variant PP013 (SEQ ID NO:1554), PP013-fused negative control Z03638 (SEQ ID NO:1552) binding a different target, and serial dilutions (200-0.003 nM) of tocilizumab (Roche) were incubated in the presence of recombinant hIL-6 (10 ng/ml; 0.5 nM) and soluble hIL-6Rα at a fixed concentration of 200 ng/ml (5.6 nM) with or without 9 µM rhHSA (Novozymes). The pre-mixed solutions with the test molecules and hIL-6/hIL-6Rα were then transferred to wells containing HUVECs, which were incubated for 24 h at 37° C. in a humidified 5% $CO_2$ atmosphere. Cell free supernatant was collected after the incubation period and human MCP-1 levels were determined by sandwich ELISA using the MCP-1 Duoset ELISA development system (R&D Systems).

MCP-1 ELISA:

Half area 96-well ELISA plates were coated with anti-MCP-1 capture antibody (R&D Systems) at a concentration of 1 µg/ml. Plates were incubated overnight at 4° C., washed twice in tap water and blocked for 1 h in PBSC. Plates were then washed four times with 4×200 µl 0.05% Tween/PBS before standards and samples were added. Plates were incubated for 2 h at RT and washed before addition of 0.1 µg/ml biotinylated anti-MCP-1 antibody (R&D Systems). Plates were then incubated for another 1.5 h, then washed four times. Next, a 1:8000 dilution of streptavidin-HRP (Thermo Scientific) was added and the plates were incubated for 1 h. The plates were washed a final four times and TMB substrate (Thermo Scientific) was added for 20 min before the reaction was stopped with 2 M $H_2SO_4$. The absorbance was measured at 450 nm using a microplate reader (Victor$^3$, Perkin Elmer).

CD Analysis:

A subset of the purified His$_6$-tagged Z variants was diluted to 0.5 mg/ml in PBS. For each diluted Z variant, a CD spectrum at 250-195 nm was obtained at 20° C. In addition, a variable temperature measurement (VTM) was performed to determine the melting temperature (Tm). In the VTM, the absorbance was measured at 221 nm while the temperature was raised from 20 to 90° C., with a temperature slope of 5° C./min. The CD measurements were performed on a Jasco J-810 spectropolarimeter (Jasco Scandinavia AB) using a cell with an optical path-length of 1 mm.

Results

Cultivation and Purification:

The 13 IL-6 binding Z variants (SEQ ID NO:1503-1515), constructed with an N-terminal His$_6$ tag, were produced in *E. coli*. The amount of IMAC-purified protein from approximately 2-5 g bacterial pellets, determined spectrophotometrically by measuring the absorbance at 280 nm, ranged from approximately 10 mg to 20 mg for the different IL-6 binding Z variants. 2 mg to 12 mg were obtained from approximately 2.5 g bacterial pellet of the five Z variants fused to the ABD variant PP013 (SEQ ID NO:1554). SDS-PAGE analysis of each final protein preparation showed that these predominantly contained the IL-6 binding Z variant. The correct identity and molecular weight of each IL-6 binding Z variant was confirmed by HPLC-MS analysis.

Figure 3:
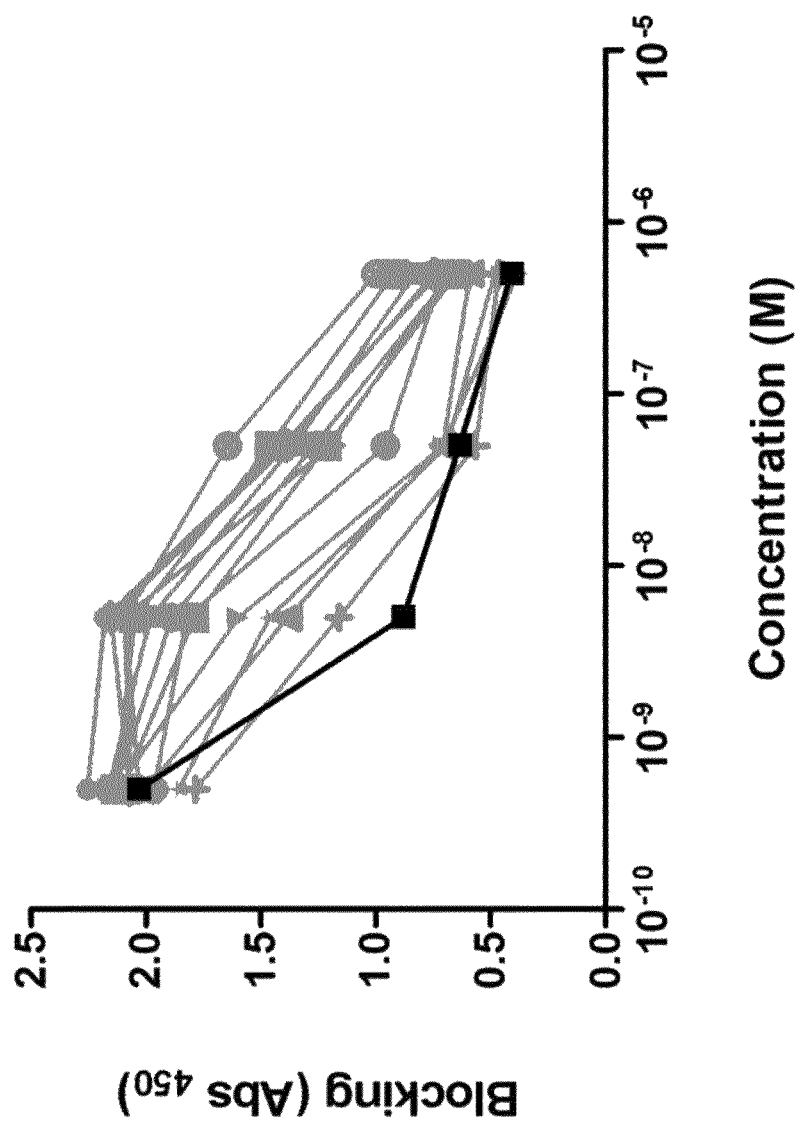
FIG. 3 shows the result of blocking of the binding of pre-mixed hIL-6/hIL-6Rα to hgp130, assayed as described in Example 2. Concentration dependent blocking was seen for all tested primary IL-6 binding Z variants (gray) as well as for tocilizumab (black), which was included for comparison. The calculated IC50 value of each variant is shown in Table 3.

Analysis of Binding Site:

The ability of the 13 tested IL-6 binding His$_6$-tagged Z variants to block the interactions between either (i) hIL-6 and hIL-6Rα or (ii) hgp130 and preformed hIL-6/hIL-6Rα was investigated in two separate competitive ELISA experiments. None of the 13 Z variants showed any significant effect when tested for blocking of the hIL-6/hIL-6Rα interaction (FIG. 2). However, all Z variants showed a clear concentration-dependent blocking of the interaction between pre-formed hIL-6/hIL-6Rα and hgp130, i.e. the trans-signaling-resembling interaction (FIG. 3). The calculated IC50 value for each Z variant is shown in Table 3. The antibody tocilizumab, included for comparison, showed a blocking effect in both experiments.

TABLE 3

IC50 values for primary Z variants blocking the hIL-6/hIL-6Rα interaction with hgp130

| Z variant | SEQ ID NO of Z variant: | IC50 (M) |
|---|---|---|
| His$_6$-Z06777 | 1503 | $4.6 \times 10^{-8}$ |
| His$_6$-Z06779 | 1504 | $3.6 \times 10^{-8}$ |
| His$_6$-Z06789 | 1505 | $6.2 \times 10^{-9}$ |
| His$_6$-Z06791 | 1506 | $2.3 \times 10^{-8}$ |
| His$_6$-Z06792 | 1507 | $1.7 \times 10^{-8}$ |
| His$_6$-Z06799 | 1508 | $3.7 \times 10^{-9}$ |
| His$_6$-Z06802 | 1509 | $2.7 \times 10^{-8}$ |
| His$_6$-Z06805 | 1510 | $4.2 \times 10^{-8}$ |
| His$_6$-Z06809 | 1511 | $3.3 \times 10^{-9}$ |
| His$_6$-Z06814 | 1512 | $1.6 \times 10^{-9}$ |
| His$_6$-Z06829 | 1513 | $1.1 \times 10^{-8}$ |
| His$_6$-Z06834 | 1514 | $5.3 \times 10^{-8}$ |
| His$_6$-Z06844 | 1515 | $8.7 \times 10^{-8}$ |

In Vitro Neutralization Assays:

Two different cell assays were used for investigating the ability of the IL-6 binding Z variants to block IL-6 dependent signaling in the classical signaling pathway and the trans-signaling pathway, respectively. The first assay, evaluating the classical signaling pathway, employed the TF-1 cell line that proliferates in response to human IL-6, TNF and GM-CSF. The direct signaling of IL-6 to cell surface IL-6 receptor, in conjunction with a signaling receptor sub-unit called gp130, is termed cis-signaling. This assay showed that all 13 variants were capable of blocking IL-6 dependent growth of the TF-1 cells. The calculated IC50 values for His$_6$-tagged Z variants and Z variants recombinantly fused to the ABD variant PP013 (SEQ ID NO:1554), as well as for the hIL-6Rα binding antibody tocilizumab included for comparison, are shown in Table 4.

TABLE 4

IC50 values for primary Z variants blocking the IL-6 dependent growth of TF-1 cells

| Z variant | SEQ ID NO of Z variant: | IC50 (M) |
|---|---|---|
| His$_6$-Z06777 | 1503 | $7.2 \times 10^{-8}$ |
| His$_6$-Z06779 | 1504 | $3.0 \times 10^{-8}$ |
| His$_6$-Z06789 | 1505 | $8.6 \times 10^{-9}$ |
| His$_6$-Z06791 | 1506 | $5.2 \times 10^{-9}$ |
| His$_6$-Z06792 | 1507 | $5.3 \times 10^{-8}$ |
| His$_6$-Z06799 | 1508 | $3.9 \times 10^{-9}$ |
| His$_6$-Z06802 | 1509 | $4.3 \times 10^{-8}$ |
| His$_6$-Z06805 | 1510 | $7.7 \times 10^{-8}$ |
| His$_6$-Z06809 | 1511 | $2.0 \times 10^{-8}$ |
| His$_6$-Z06814 | 1512 | $1.6 \times 10^{-9}$ |
| His$_6$-Z06829 | 1513 | $2.8 \times 10^{-8}$ |
| His$_6$-Z06834 | 1514 | $6.1 \times 10^{-8}$ |
| His$_6$-Z06844 | 1515 | $1.1 \times 10^{-7}$ |
| Z06789-ABD | 1505 | $\sim 1 \times 10^{-7}$ |
| Z06799-ABD | 1508 | $2.4 \times 10^{-9}$ |
| Z06809-ABD | 1511 | $1.0 \times 10^{-8}$ |
| Z06814-ABD | 1512 | $8.0 \times 10^{-10}$ |
| Z06829-ABD | 1513 | $1.5 \times 10^{-8}$ |
| tocilizumab | | $3.0 \times 10^{-10}$ |

Figure 4:
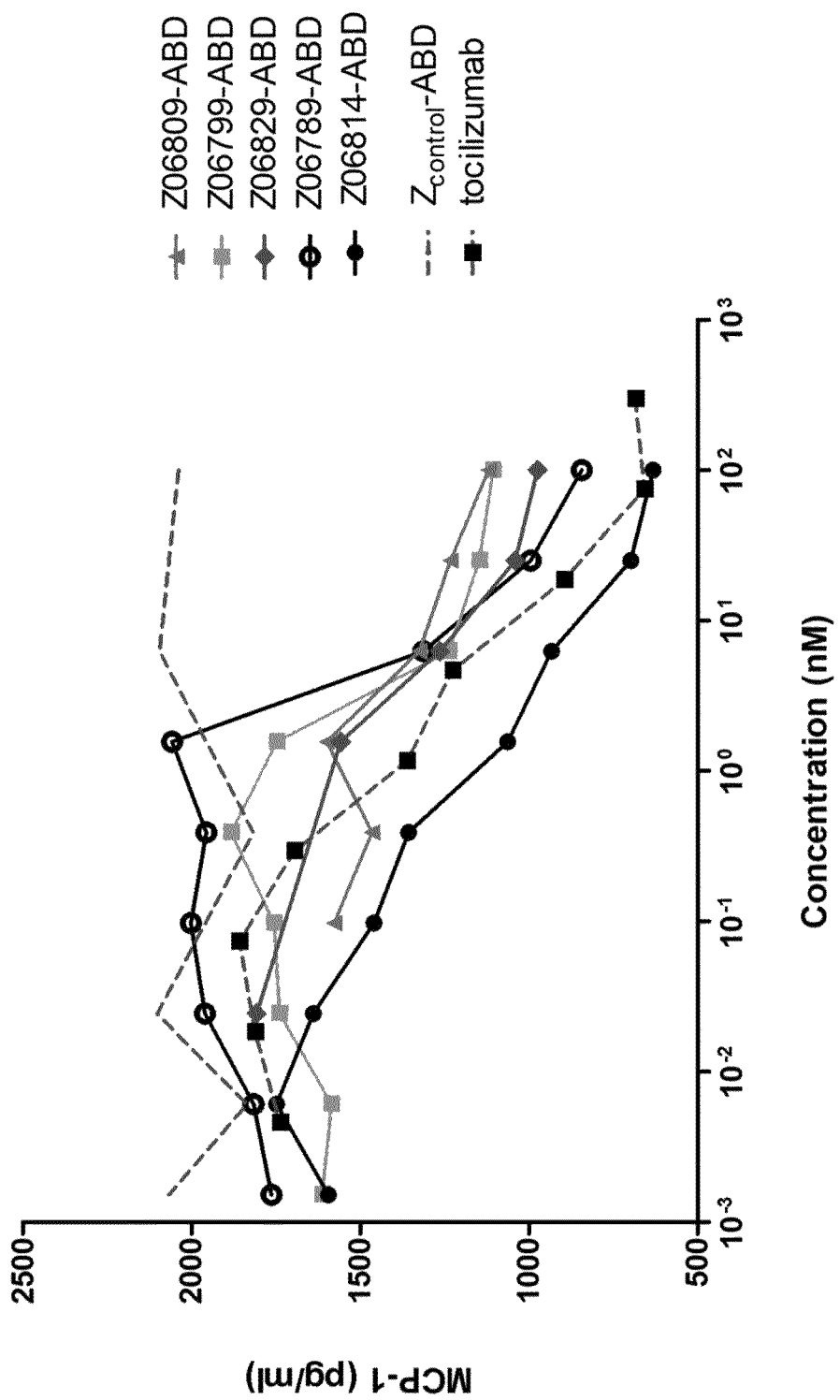
FIG. 4 shows concentration dependent inhibition of IL-6 mediated trans-signaling in a gp130 expressing human umbilical vein endothelial cell (HUVEC) based system, assayed as described in Example 2. IL-6 binding Z variants C-terminally fused to the ABD variant PP013 (SEQ ID NO:1554) inhibited the trans-signaling, whereas the control Z variant Z03638 (SEQ ID NO:1552) in fusion with PP013 did not. Tocilizumab was included for comparison.

To investigate if also the trans-signaling pathway could be blocked in a cell based system, a second assay using gp130 expressing human umbilical vein endothelial cells (HUVECs) was performed. Incubation of HUVECs with preformed hIL-6/hIL-6Rα results in IL-6 trans-signaling dependent secretion of Monocyte Chemoattractant Protein-1 (MCP-1), allowing for analysis of any trans-signaling blocking capabilities of IL-6 binding Z variants. In this assay, five Z variants recombinantly fused to the ABD variant PP013 (SEQ ID NO:1554) were analyzed in the presence of HSA. The hIL-6Rα binding antibody tocilizumab was included for comparison. All five investigated Z variants were shown to inhibit trans-signaling (FIG. 4). One variant, Z06814-ABD, was shown to be more potent than tocilizumab and exhibited an approximate IC50 value of 1 nM compared to 5 nM for tocilizumab.

CD Analysis:

The CD spectra determined for seven Z variants showed that each had an α-helical structure at 20° C. The melting temperatures (Tm) determined through variable temperature measurements are shown in Table 5.

TABLE 5

Melting temperatures for a selection of Z variants

| Z variant | SEQ ID NO: | Tm (° C.) |
|---|---|---|
| His$_6$-Z06779 | 1504 | 51 |
| His$_6$-Z06789 | 1505 | 52 |
| His$_6$-Z06792 | 1507 | 48 |
| His$_6$-Z06799 | 1508 | 44 |
| His$_6$-Z06809 | 1511 | 51 |
| His$_6$-Z06814 | 1512 | 49 |
| His$_6$-Z06829 | 1513 | 40 |

Example 3

Design and Construction of a First Maturated Library of IL-6 Binding Z Variants

In this Example, a maturated library was constructed. The library was used for selections of new IL-6 binding Z variants. Selections from maturated libraries are usually expected to result in binders with increased affinity (Orlova et al., (2006) Cancer Res 66(8):4339-48). In this study randomized single stranded linkers were generated, using split-pool synthesis, enabling incorporation of defined codons in desired positions in the synthesis.

Materials and Methods

Library Design:

The library was based on a selection of sequences of the IL-6 binding Z variants described in Example 1 and 2. In the new library, 12 variable positions in the Z molecule scaffold were biased towards certain amino acid residues and one position was kept constant, according to a strategy based on the Z variant sequences defined in SEQ ID NO:1503-1551. Using split-pool synthesis, a DNA linker of 147 bp was generated, encoding a partially randomized helix 1 and 2 of the Z variant amino acid sequence. Thus, 5'-AA ATA AAT CTC GAG GTA GAT GCC AAA TAC GCC AAA GAA NNN NNN NNN GCG TGG NNN GAG ATC NNN NNN CTG CCT AAC CTC ACC NNN NNN CAA NNN NNN GCC TTC ATC NNN AAA TTA NNN GAT GAC CCA AGC CAG AGC TCA TTA TTT A-3' (SEQ ID NO:1563, randomized codons denoted NNN) flanked by restriction sites XhoI and SacI, was ordered from DNA 2.0 (Menlo Park, Calif., USA). The theoretical distributions of amino acid residues in the new library including 12 variable Z positions (9, 10, 11, 14, 17, 18, 24, 25, 27, 28, 32 and 35) in the Z molecule scaffold are given in Table 6. The resulting theoretical library size is $3.6 \times 10^9$ variants.

TABLE 6

Library design, first maturation

| Amino acid position in Z | Randomization (amino acid abbreviations) | No of amino acids | Proportion |
|---|---|---|---|
| 9 | E (70%), H, Q, T, | 4 | 1/10, 7/10 (E) |
| 10 | A, H, Q, R, | 4 | 1/4 |
| 11 | A, D, E, H, K, Q, R, S, T, V | 10 | 1/10 |
| 13 | W | 1 | 1/1 |
| 14 | A, F, H, L, R, S, T, W, Y | 9 | 1/9 |
| 17 | H (70%), Q, S, T | 4 | 1/10, 7/10 (H) |
| 18 | A, H, I, K, L, M, S, T, V | 9 | 1/9 |
| 24 | A, H, I, T, V | 5 | 1/5 |
| 25 | D, E, H, N, Q, R, S, T | 8 | 1/8 |
| 27 | A, H, I, L, M, R, T, V | 8 | 1/8 |
| 28 | A, E, H, S, T, V | 6 | 1/6 |
| 32 | A, H, I, M, Q, S, T, V, W | 9 | 1/9 |
| 35 | F, L, M, Y | 4 | 1/4 |

Library Construction:

The library was amplified using AmpliTaq Gold polymerase (Applied Biosystems, cat. no. 4311816) during 12 cycles of PCR and pooled products were purified with QIAquick PCR Purification Kit (QIAGEN, cat. no. 28106) according to the supplier's recommendations. The purified pool of randomized library fragments was digested with restriction enzymes XhoI and SacI-HF (New England Biolabs, cat. no. R0146L, and cat. no. R3156M) and concentrated using a PCR Purification Kit (QIAGEN, cat. no. 28106). Subsequently, the product was run on a preparative 2.5% agarose gel (Nuisieve GTC agarose, Cambrex, Invitrogen) and purified using a QIAGEN gel extraction Kit (QIAGEN, cat. no. 28706) according to the supplier's recommendations.

The phagemid vector pAY02592 (essentially as pAffi1 described in Grönwall et al supra) was restricted with the same enzymes and purified using phenol/chloroform extraction and ethanol precipitation. The restricted fragments and vector were ligated in a molar ratio of 5:1 with T4 DNA ligase (Fermentas, cat. no. EL0011) for 2 h at RT, followed by overnight incubation at 4° C. The ligated DNA was recovered by phenol/chloroform extraction and ethanol precipitation, followed by dissolution in 10 mM Tris-HCl, pH 8.5. Thus, the resulting library in vector pAY02592 encoded Z variants, each fused to an albumin binding domain (ABD) derived from streptococcal protein G.

The ligation reactions (approximately 160 ng DNA/transformation) were electroporated into electrocompetent E. coli ER2738 cells (50 μl, Lucigen, Middleton, Wis., USA). Immediately after electroporation, approximately 1 ml of recovery medium (supplied with the ER2738 cells) was added. The transformed cells were incubated at 37° C. for 60 min. Samples were taken for titration and for determination of the number of transformants. Next, the cells were pooled and cultivated overnight at 37° C. in 1 l of TSB-YE medium, supplemented with 2% glucose, 10 μg/ml tetracycline and 100 μg/ml ampicillin. The cells were pelleted for 7 min at 4,000 g and resuspended in a PBS/glycerol solution (approximately 40% glycerol), aliquoted and stored at −80° C. Clones from the library of Z variants were sequenced in order to verify the content and to evaluate the outcome of the constructed library vis-à-vis the library design. Sequencing was performed as described in Example 1 and the amino acid distribution was verified.

Preparation of Phage Stock:

Phage stock containing the phagemid library was prepared in a 20 l fermenter (Belach Bioteknik). Cells from a glycerol stock containing the phagemid library were inoculated in 10 l of TSB-YE (Tryptic Soy Broth-Yeast Extract; 30 g/l TSB, 5 g/l yeast extract) supplemented with 1 g/l glucose, 100 mg/l ampicillin and 10 mg/l tetracycline. When the cells reached an optical density at 600 nm ($OD_{600}$) of 0.64, approximately 1.1 l of the cultivation was infected using a 5× molar excess of M13K07 helper phage. The cells were incubated for 30 min, whereupon the fermenter was filled up to 10 l with complex fermentation medium [2.5 g/l $(NH_4)_2SO_4$, 5.0 g/l yeast extract; 30 g/l tryptone, 2 g/l $K_2HPO_4$; 3 g/l $KH_2PO_4$, 1.25 g/l, $Na_3C_6H_5O_7.2H_2O$; Breox FMT30 antifoaming agent 0.1 ml/l]. The following components were added: 10 ml carbenicillin 25 mg/ml, 5 ml kanamycin 50 mg/ml, 1 ml 1 M isopropyl-β-D-1-thiogalactopyranoside (IPTG); 17.5 ml/l of 300 g/l $MgSO_4$ and 5 ml of a trace element solution [35 g/l $FeCl_3.6H_2O$; 10.56 g/l $ZnSO_4.7H_2O$; 2.64 g/l $CuSO_4.5H_2O$; 13.2 g/l $MnSO_4.H_2O$; 13.84 g/l $CaCl_2.2H_2O$, dissolved in 1.2 M HCl]. A glucose limited fed-batch cultivation was started where a 600 g/l glucose solution was fed to the reactor (3.5 g/h in the start, 37.5 g/h after 20 h and until the end of the cultivation). The pH was controlled at pH 7 through the automatic addition of 25% $NH_4OH$. Air was supplemented (5 l/min) and the stirrer was set at 500 rpm. After 24 h of fed-batch cultivation the $OD_{600}$ was 22. The cells in the cultivation were pelleted by centrifugation at 15,900 g. The phage particles were precipitated twice from the supernatant in PEG/NaCl, filtered and dissolved in PBS and glycerol as described in Example 1. Phage stocks were stored at −80° C. until use in selection.

Results

Library Construction:

The new library was designed based on a set of IL-6 binding Z variants with verified binding properties (Example 1 and 2). The theoretical size of the designed library was $3.6 \times 10^9$ Z variants. The actual size of the library, determined by titration after transformation to *E. coli* ER2738 cells, was $3.5 \times 10^9$ transformants.

The library quality was tested by sequencing of 192 transformants and by comparing their actual sequences with the theoretical design. The contents of the actual library compared to the designed library were shown to be satisfactory. A maturated library of potential binders to IL-6 was thus successfully constructed.

Example 4

Selection, Screening and Characterization of Z Variants from the First Maturated Library Materials and Methods Phage Display Selection of Matured IL-6 Binding Z Variants:

The target proteins hIL-6 (R&D Systems, cat. no. 206-IL/CF) and mIL-6 (Abnova, cat. no. P4346 I16) were biotinylated as described in Example 1. Phage display selections, using the new library of Z variant molecules described in Example 3, were performed in four cycles against hIL-6 and mIL-6 essentially as described in Example 1 with the following exceptions. At selection, fetal calf serum (FCS, Gibco, cat. no. 10108-165) and human serum albumin (HSA, Albucult, Novozymes, cat. no. 230-005) were added to the selection buffer to a final concentration of 10% and 1.5 µM, respectively. All tubes and beads used in the selection were pre-blocked with PBST 0.1% supplemented with 3% BSA. In cycle 1A, a pre-selection step was performed by incubation of phage stock with SA-beads. The selection volume was 2 ml in cycle 1 for all tracks. For capture of target-bound phage, 1 mg beads per 4 µg biotinylated hIL-6 or mIL-6 was used.

The six tracks (1-6) in cycle 1 were divided either in the second cycle or the third cycle, resulting in totally seven tracks (1-1 to 6-2) in cycle 2, twelve tracks (1-1-1 to 6-2-1) in cycle 3 and twelve tracks (1-1-1-1 to 6-2-1-1) in cycle 4.

The bound phage particles were eluted using two different procedures; 1) 500 µl 0.1 M glycine-HCl, pH 2.2, followed by immediate neutralization with 50 µl 1 M Tris-HCl, pH 8.0, and 450 µl PBS, or 2) 500 µl of 100 mM sodium phosphate and 150 mM sodium chloride, pH 5.5 and neutralization with 500 µl PBS.

An overview of the selection strategy, describing an increased stringency in subsequent cycles obtained by using a lowered target concentration and an increased number of washes, is shown in Table 7.

TABLE 7

Overview of the selection strategy for the first maturation

| Cycle | Selection track | Phage stock from library or selection track | Target | Target concentration (nM) | Number of washes | Elution at |
|---|---|---|---|---|---|---|
| 1 | 1 | Zlib006IL-6.I | hIL-6 | 50 | 2 | pH 2.2 |
| 1 | 2 | Zlib006IL-6.I | hIL-6 | 25 | 2 | pH 2.2 |
| 1 | 3 | Zlib006IL-6.I | hIL-6 | 10 | 3 | pH 2.2 |
| 1 | 4 | Zlib006IL-6.I | hIL-6 | 50 | 2 | pH 5.45 |
| 1 | 5 | Zlib006IL-6.I | hIL-6 | 25 | 2 | pH 5.45 |
| 1 | 6 | Zlib006IL-6.I | mIL-6 | 100 | 2 | pH 2.2 |
| 2 | 1-1 | 1 | hIL-6 | 25 | 8 | pH 2.2 |
| 2 | 2-1 | 2 | hIL-6 | 10 | 8 | pH 2.2 |
| 2 | 3-1 | 3 | hIL-6 | 2.5 | 12 | pH 2.2 |
| 2 | 4-1 | 4 | hIL-6 | 25 | 8 | pH 5.45 |
| 2 | 5-1 | 5 | hIL-6 | 10 | 8 | pH 5.45 |
| 2 | 6-1 | 6 | mIL-6 | 100 | 4 | pH 2.2 |
| 2 | 6-2 | 6 | mIL-6 | 50 | 6 | pH 2.2 |
| 3 | 1-1-1 | 1-1 | hIL-6 | 5 | 12 | pH 2.2 |
| 3 | 1-1-2 | 1-1 | hIL-6 | 1.25 | 15 | pH 2.2 |
| 3 | 2-1-1 | 2-1 | hIL-6 | 1.25 | 12 | pH 2.2 |
| 3 | 2-1-2 | 2-1 | hIL-6 | 0.5 | 15 | pH 2.2 |
| 3 | 3-1-1 | 3-1 | hIL-6 | 0.5 | 20 | pH 2.2 |
| 3 | 3-1-2 | 3-1 | hIL-6 | 0.05 | 20 | pH 2.2 |
| 3 | 4-1-1 | 4-1 | hIL-6 | 5 | 12 | pH 5.45 |
| 3 | 4-1-2 | 4-1 | hIL-6 | 1.25 | 15 | pH 5.45 |
| 3 | 5-1-1 | 5-1 | hIL-6 | 2.5 | 12 | pH 5.45 |
| 3 | 5-1-2 | 5-1 | hIL-6 | 1 | 15 | pH 5.45 |
| 3 | 6-1-1 | 6-1 | mIL-6 | 50 | 11 | pH 2.2 |
| 3 | 6-2-1 | 6-2 | mIL-6 | 25 | 11 | pH 2.2 |
| 4 | 1-1-1-1 | 1-1-1 | hIL-6 | 0.5 | 16 | pH 2.2 |
| 4 | 1-1-2-1 | 1-1-2 | hIL-6 | 0.05 | 20 | pH 2.2 |
| 4 | 2-1-1-1 | 2-1-1 | hIL-6 | 0.1 | 16 | pH 2.2 |
| 4 | 2-1-2-1 | 2-1-2 | hIL-6 | 0.025 | 20 | pH 2.2 |
| 4 | 3-1-1-1 | 3-1-1 | hIL-6 | 0.025 | 30 | pH 2.2 |
| 4 | 3-1-2-1 | 3-1-2 | hIL-6 | 0.0025 | 30 | pH 2.2 |
| 4 | 4-1-1-1 | 4-1-1 | hIL-6 | 1 | 16 | pH 5.45 |
| 4 | 4-1-2-1 | 4-1-2 | hIL-6 | 0.1 | 20 | pH 5.45 |
| 4 | 5-1-1-1 | 5-1-1 | hIL-6 | 0.2 | 16 | pH 5.45 |
| 4 | 5-1-2-1 | 5-1-2 | hIL-6 | 0.05 | 20 | pH 5.45 |
| 4 | 6-1-1-1 | 6-1-1 | mIL-6 | 10 | 12 | pH 2.2 |
| 4 | 6-2-1-1 | 6-2-1 | mIL-6 | 1 | 16 | pH 2.2 |

Amplification of Phage Particles:

Amplification of phage particles between selection cycle 1 and 2 was performed essentially as described in Example 1, with the following exceptions. *E. coli* ER2738 was used for phage amplification and M13K07 helper phage was used in 5× excess. The amplification of phage particles between the selection cycles 2 and 4 was done by infection of bacteria in solution according to the following. After infection of log phase *E. coli* ER2738 with phage particles, TSB supplemented with 2% glucose, 10 µg/ml tetracycline and 100 µg/ml ampicillin was added, followed by incubation with rotation for 30 min at 37° C. Thereafter, the bacteria were infected with M13K$_{07}$ helper phage. The infected bacteria were pelleted by centrifugation, re-suspended in TSB-YE medium supplemented with 100 µM IPTG, 25 µg/ml kanamycin and 100 µg/ml ampicillin, and grown overnight at 30° C. The overnight cultures were centrifuged and phage particles in the supernatant were precipitated twice with PEG/NaCl buffer. Finally, the phage particles were re-suspended in selection buffer before entering the next selection cycle. In the last selection cycle, log phase bacteria were infected with eluate and diluted before spreading onto TBAB plates (30 g/l tryptose blood agar base, Oxoid cat. no. CM0233B) supplemented with 0.2 g/l ampicillin in order to form single colonies for use in ELISA screening.

Sequencing of Potential Binders:

Individual clones from the different selection tracks were picked for sequencing. All clones run in the ELISA screening were sequenced. Amplification of gene fragments and sequence analysis of gene fragments were performed essentially as described in Example 1.

ELISA Screening of Z Variants:

Single colonies containing Z variants (expressed as Z variant ABD fusion proteins) were randomly picked from the selected clones of the IL-6 maturated library and cultivated as described in Example 1. Preparation of the periplasmic supernatants was performed as in Example 1 but with six freeze thawing cycles. ELISA screenings were performed essentially as described in Example 1 using biotinylated hIL-6 at a concentration of 0.58 nM. The periplasmic fraction of the primary IL-6 binder Z06814 was used as a positive control. A negative control was created by using periplasm containing ABD only.

ELISA EC50 Analysis of Human IL-6 Binders:

A selection of IL-6 binders was subjected to an analysis of the response against a dilution series of biotinylated hIL-6 using ELISA as described above. Biotinylated protein was added at a concentration of 25 nM and diluted stepwise 1:3 down to 11 pM. All Z variants were also assayed without added target protein as a background control. Periplasm samples containing the primary IL-6 binder Z06814 (SEQ ID. NO:1512) were included and analyzed as a positive control. As a negative control, periplasm containing ABD only was assayed against biotinylated hIL-6. Two binders originating from the selection against mIL-6, Z11612 (SEQ ID NO:151) and Z11616 (SEQ ID NO:152) were subjected to an analysis of the response against a dilution series of biotinylated mIL-6 using ELISA as described above. Biotinylated protein was added at a concentration of 227 nM and diluted stepwise 1:3 down to 104 pM. Obtained values were analyzed using GraphPad Prism 5 and non-linear regression.

Results

Phage Display Selection of Maturated IL-6 Binding Z Variants:

Selection was performed in totally 12 parallel tracks containing four cycles each. The different selection tracks differed in target concentration, target type (hIL-6 or mIL-6), selection time, wash conditions and the pH of the elution buffer.

Sequencing:

Randomly picked clones were sequenced. Each individual Z variant was given an identification number, Z #####, as described in Example 1. In total, 809 new unique Z variant molecules were identified.

The amino acid sequences of 58 residues long Z variants are listed in FIG. 1 and in the sequence listing as SEQ ID NO:7, SEQ ID NO:15-89 and SEQ ID NO:151-871. The deduced IL-6 binding motifs (BM) extend from position 8 to position 36 in each sequence. The amino acid sequences of the 49 amino acid residues long polypeptides predicted to constitute the complete three-helix bundle within each of these Z variants (BMod) extend from position 7 to position 55.

ELISA Screening of Z Variants:

Clones obtained after four selection cycles were produced in 96-well plates and screened for hIL-6 binding activity using ELISA. All randomly picked clones were analyzed. 796 of the 809 unique Z variants were found to give a response of 3× the negative control or higher (0.3-2.1 AU) against hIL-6 at a concentration of 0.58 nM. Clones from all selection tracks using hIL-6 as selection target showed positive signals. The negative controls had absorbencies of 0.078-0.102 AU. The average response of the blank controls of a representative set of plates was 0.087 AU.

ELISA EC50 Analysis of IL-6 Binders:

A subset of Z variants was selected based on the result in the ELISA experiment described above (highest ELISA value normalized against the positive control on each plate, respectively) and subjected to a target titration in ELISA format. Periplasm samples were incubated with a serial dilution of biotinylated hIL-6 or mIL-6. A periplasm sample with the primary binder Z06814 (SEQ ID NO:1512) was also assayed against hIL-6 as a positive control. Obtained values were analyzed and their respective EC50 values were calculated (Tables 8 and 9).

TABLE 8

Calculated EC50 values against hIL-6

| Z variant | SEQ ID NO | EC50 ELISA (M) |
|---|---|---|
| Z11213 | 15 | $1.5 \times 10^{-10}$ |
| Z11214 | 16 | $1.3 \times 10^{-10}$ |
| Z11215 | 17 | $1.4 \times 10^{-10}$ |
| Z11217 | 18 | $1.3 \times 10^{-10}$ |
| Z11222 | 19 | $1.4 \times 10^{-10}$ |
| Z11251 | 20 | $1.4 \times 10^{-10}$ |
| Z11277 | 21 | $1.2 \times 10^{-10}$ |
| Z11278 | 22 | $1.5 \times 10^{-10}$ |
| Z11283 | 23 | $1.8 \times 10^{-10}$ |
| Z11300 | 24 | $1.9 \times 10^{-10}$ |
| Z11321 | 25 | $1.4 \times 10^{-10}$ |
| Z11329 | 26 | $1.4 \times 10^{-10}$ |
| Z11351 | 27 | $1.7 \times 10^{-10}$ |
| Z11380 | 28 | $1.7 \times 10^{-10}$ |
| Z11384 | 29 | $1.5 \times 10^{-10}$ |
| Z11433 | 30 | $2.1 \times 10^{-10}$ |
| Z11472 | 31 | $1.8 \times 10^{-10}$ |
| Z11552 | 32 | $1.2 \times 10^{-9}$ |
| Z11632 | 7 | $1.9 \times 10^{-10}$ |
| Z11642 | 33 | $2.3 \times 10^{-10}$ |
| Z11644 | 34 | $2.4 \times 10^{-10}$ |
| Z11674 | 35 | $2.6 \times 10^{-10}$ |
| Z11698 | 36 | $2.0 \times 10^{-10}$ |
| Z11711 | 37 | $3.5 \times 10^{-10}$ |
| Z11723 | 38 | $2.5 \times 10^{-10}$ |
| Z11781 | 39 | $2.9 \times 10^{-10}$ |
| Z11784 | 40 | $2.7 \times 10^{-10}$ |
| Z11788 | 41 | $2.5 \times 10^{-10}$ |
| Z11789 | 42 | $2.4 \times 10^{-10}$ |
| Z11791 | 43 | $3.4 \times 10^{-10}$ |
| Z11794 | 44 | $2.2 \times 10^{-10}$ |
| Z11802 | 45 | $2.6 \times 10^{-10}$ |
| Z11803 | 46 | $2.8 \times 10^{-10}$ |
| Z11805 | 47 | $3.4 \times 10^{-10}$ |

TABLE 8-continued

Calculated EC50 values against hIL-6

| Z variant | SEQ ID NO | EC50 ELISA (M) |
|---|---|---|
| Z11814 | 48 | $2.5 \times 10^{-10}$ |
| Z11815 | 49 | $2.8 \times 10^{-10}$ |
| Z11817 | 50 | $2.5 \times 10^{-10}$ |
| Z11818 | 51 | $2.4 \times 10^{-10}$ |
| Z11819 | 52 | $2.5 \times 10^{-10}$ |
| Z11823 | 53 | $2.1 \times 10^{-10}$ |
| Z11824 | 54 | $2.3 \times 10^{-10}$ |
| Z11833 | 55 | $2.9 \times 10^{-10}$ |
| Z11835 | 56 | $2.9 \times 10^{-10}$ |
| Z11836 | 57 | $3.6 \times 10^{-10}$ |
| Z11860 | 58 | $1.8 \times 10^{-10}$ |
| Z11861 | 59 | $2.2 \times 10^{-10}$ |
| Z11862 | 60 | $1.9 \times 10^{-10}$ |
| Z11865 | 61 | $2.3 \times 10^{-10}$ |
| Z11866 | 62 | $2.5 \times 10^{-10}$ |
| Z11871 | 63 | $1.7 \times 10^{-10}$ |
| Z11872 | 64 | $2.8 \times 10^{-10}$ |
| Z11874 | 65 | $3.1 \times 10^{-10}$ |
| Z11875 | 66 | $2.1 \times 10^{-10}$ |
| Z11881 | 67 | $1.7 \times 10^{-10}$ |
| Z11882 | 68 | $1.4 \times 10^{-10}$ |
| Z11883 | 69 | $2.1 \times 10^{-10}$ |
| Z11890 | 70 | $1.9 \times 10^{-10}$ |
| Z11892 | 71 | $2.3 \times 10^{-10}$ |
| Z11893 | 72 | $2.0 \times 10^{-10}$ |
| Z11895 | 73 | $2.8 \times 10^{-10}$ |
| Z11896 | 74 | $2.9 \times 10^{-10}$ |
| Z11897 | 75 | $3.0 \times 10^{-10}$ |
| Z11901 | 76 | $1.7 \times 10^{-10}$ |
| Z11903 | 77 | $2.3 \times 10^{-10}$ |
| Z11904 | 78 | $2.4 \times 10^{-10}$ |
| Z11905 | 79 | $3.1 \times 10^{-10}$ |
| Z11906 | 80 | $2.5 \times 10^{-10}$ |
| Z11907 | 81 | $3.6 \times 10^{-10}$ |
| Z11912 | 82 | $1.8 \times 10^{-10}$ |
| Z11918 | 83 | $3.2 \times 10^{-10}$ |
| Z11922 | 84 | $2.7 \times 10^{-10}$ |
| Z11923 | 85 | $2.1 \times 10^{-10}$ |
| Z11929 | 86 | $2.6 \times 10^{-10}$ |
| Z11933 | 87 | $1.6 \times 10^{-10}$ |
| Z11937 | 88 | $3.0 \times 10^{-10}$ |
| Z11939 | 89 | $2.1 \times 10^{-10}$ |
| Z06814 | 1512 | $2.9 \times 10^{-10}$ |

TABLE 9

Calculated EC50 values against mIL-6

| Z variant | SEQ ID NO | EC50 ELISA (M) |
|---|---|---|
| Z11612 | 151 | $9.3 \times 10^{-9}$ |
| Z11616 | 152 | $7.7 \times 10^{-9}$ |

Example 5

Design and Construction of a Second Maturated Library of IL-6 Binding Z Variants In this Example, a second maturated library was constructed essentially as described in Example 4. The library was used for selections of IL-6 binding Z variants.

Materials and Methods

Library Design:

The library was primarily based on a selection of sequences of the human IL-6 binding Z variants described in Example 4. In the new library, 13 variable positions in the Z molecule scaffold were biased towards certain amino acid residues, according to a strategy mainly based on the Z variants from the first maturation, i.e. sequences defined in SEQ ID NO:7, SEQ ID NO:15-89 and SEQ ID NO:151-871. Randomized double stranded linkers were generated by the COLIBRA technology, which enables incorporation of randomized sets of trinucleotide building blocks using ligations and restrictions of the subsequently built up double stranded DNA. A library of double-stranded DNA, 5'-AA ATA AAT CTC GAG GTA GAT GCC AAA TAC GCC AAA GAA NNN NNN NNN GCT NNN NNN GAG ATC NNN NNN CTG CCG AAC CTG ACC NNN NNN CAG NNN NNN GCC TTC ATC NNN AAA TTA NNN GAT GAC CCA AGC CAG AGC TCA TTA TTT A-3' (SEQ ID NO:1564, randomized codons are denoted NNN) encoding a partially randomized helix 1 and 2 of the Z variant amino acid sequence, flanked by restriction sites XhoI and SacI, was ordered from Isogenica (Essex, UK). The theoretical distributions of amino acid residues in the new library, including eight variable amino acid positions (10, 11, 14, 18, 24, 25, 27 and 32) and five constant amino acid positions (9, 13, 17, 28, and 35) in the Z molecule scaffold are given in Table 10. The resulting theoretical library size was $2.6 \times 10^7$ variants.

Library Construction and Phage Stock Preparation:

The library was constructed essentially as described in Example 3. Phage stock of the library was prepared as described in Example 3.

TABLE 10

Library design, second maturation

| Amino acid position in Z | Allowed amino acids | No of amino acids | Proportion |
|---|---|---|---|
| 9 | E | 1 | 1/1 |
| 10 | A, D, E, F, H, I, K, L, N, Q, R, S, T, V, W, Y | 1 | 1/16 |
| 11 | A, D, E, F, G, H, I, K, L, M, N, Q, R, S, T, V, W, Y | 17 | 1/18 |
| 13 | W | 1 | 1/1 |
| 14 | A, D, E, F, H, I, K, L, M, N, Q, R, S, T, V, W, Y | 7 | 1/17 |
| 17 | H | 1 | 1/1 |
| 18 | A, D, E, F, G, H, I, K, L, N, Q, R, S, T, V, W, Y | 17 | 1/17 |
| 24 | I, L, V | 1 | 1/3 |
| 25 | A, D, E, F, G, H, I, K, L, N, Q, R, S, T, V, W, Y | 10 | 1/17 |
| 27 | I, M, V | 1 | 1/3 |
| 28 | A | 12 | 1/1 |
| 32 | S, T | 16 | 1/2 |
| 35 | F | 1 | 1/1 |

Results

Library Construction and Phage Stock Preparation:

The new library was designed based on a set of IL-6 binding Z variants with verified binding properties (Example 4). The theoretical size of the designed library was $2.6 \times 10^7$ Z variants. The actual size of the library, determined by titration after transformation to E. coli ER2738 cells, was $1.8 \times 10^9$ transformants.

The library quality was tested by sequencing of 192 transformants and by comparing their actual sequences with the theoretical design. The contents of the actual library compared to the theoretical library were shown to be satisfying. A maturated library of potential binders to IL-6 was thus successfully constructed.

Example 6

Selection, Screening and Characterization of Z Variants from the Second Maturated Library Materials and Methods Second Phage Display Selection of Maturated IL-6 Binding Z Variants:

The target protein hIL-6 was biotinylated as described in Example 4. Phage display selections, using the second maturated library of Z variant molecules described in Example 5 were performed against hIL-6 essentially as described in Example 4, with the following exceptions. The selection volume was 4 ml in cycle 1 for all tracks. In cycle 2, selection tracks 1-2 and 1-3 were handled in one common tube and not separated until after the last 1 min wash, whereupon they were treated separately. Also in cycle 4, each set of the selection tracks 1-1-1-1 to 1-1-1-3, 1-1-1-4 to 1-1-1-6, 1-1-2-1 to 1-1-2-3 and 1-1-2-4 to 1-1-2-6, respectively, were handled in a common tube and split into three separate tubes after the last 1 min wash and thereafter treated separately using the different washing strategies outlined in Table 11. The bound phage particles were eluted using glycine-HCl, pH 2.2, as described in Example 1. The amplification of phage particles between the selection cycles was performed essentially as described in Example 1.

An overview of the selection strategy and parameters used, describing the differences in the selection tracks in terms of lowered target concentration and an increased number of washes, is shown in Table 11.

Sequencing of Potential Binders:

Individual clones from the different selection tracks were picked for sequencing. All clones subjected to the ELISA screening were sequenced. Amplification of gene fragments and sequence analysis of gene fragments were performed essentially as described in Example 1.

ELISA Screening of Z Variants:

Single colonies containing Z variants (expressed as Z variant ABD fusion proteins as described in Example 1) were randomly picked from the selected clones of the IL-6 second maturated library and cultivated as described in Example 1. Preparation of the periplasmic supernatants and ELISA screenings were performed essentially as described in Example 1 and freeze thawing was performed in 150 µl PBST 0.05% and repeated 8 times. Biotinylated hIL-6 was used at a concentration of 0.25 nM. The periplasmic fraction of the IL-6 binder Z06814 (SEQ ID NO:1512) was used in duplicate as positive control on each ELISA plate. As a negative control, periplasm containing ABD only was assayed against biotinylated hIL-6.

ELISA EC50 Analysis of IL-6 Binders:

A selection of IL-6 binders was subjected to an analysis of the response against a dilution series of biontinylated hIL-6 using ELISA as described in Example 2. Biotinylated protein was added at a concentration of 5 nM and diluted stepwise 1:3 down to 83 fM. As a background control, all Z variants were also assayed with without added target protein. Periplasm samples containing the primary IL-6 binder Z06814 (SEQ ID NO:1512) as well as maturated binder Z11632 (SEQ ID NO:7) were included as positive controls. As a negative control, periplasm containing ABD only was

TABLE 11

Overview of the selection strategy for the second maturation

| Cycle | Selection track | Phage stock from library or selection track | Target concentration (nM) | Number of 1 min washes | Number of 4 h washes | Number of 4 h washes with unlabeled Z06814 | Number of overnight washes | Number of over weekend washes |
|---|---|---|---|---|---|---|---|---|
| 1 | 1 | Zlib006IL-6A.II | 50 | 5 | — | — | — | — |
| 1 | 2 | Zlib006IL-6A.II | 10 | 5 | — | — | — | — |
| 2 | 1-1 | 1 | 10 | 15 | — | — | — | — |
| 2 | 1-2 | 1 | 5 | 15 | — | — | — | — |
| 2 | 1-3 | 1 | 5 | 15 | 1 | — | — | — |
| 2 | 2-1 | 2 | 2.5 | 12 | — | — | — | — |
| 3 | 1-1-1 | 1-1 | 1 | 5 | — | 1 | — | — |
| 3 | 1-1-2 | 1-1 | 1 | 5 | — | 1 | — | — |
| 3 | 1-2-1 | 1-2 | 0.5 | 15 | — | — | — | — |
| 3 | 1-3-1 | 1-3 | 0.5 | 15 | — | — | — | — |
| 3 | 2-1-1 | 2-1 | 0.5 | 12 | — | — | — | — |
| 3 | 2-1-2 | 2-1 | 0.1 | 12 | — | — | — | — |
| 4 | 1-1-1-1 | 1-1-1 | 1 | 5 | — | 1 | — | — |
| 4 | 1-1-1-2 | 1-1-1 | 1 | 5 | — | — | 1 | — |
| 4 | 1-1-1-3 | 1-1-1 | 1 | 5 | — | — | — | 1 |
| 4 | 1-1-1-4 | 1-1-1 | 1 | 5 | — | 1 | — | — |
| 4 | 1-1-1-5 | 1-1-1 | 1 | 5 | — | — | 1 | — |
| 4 | 1-1-1-6 | 1-1-1 | 1 | 5 | — | — | — | 1 |
| 4 | 1-1-2-1 | 1-1-2 | 1 | 5 | — | 1 | — | — |
| 4 | 1-1-2-2 | 1-1-2 | 1 | 5 | — | — | 1 | — |
| 4 | 1-1-2-3 | 1-1-2 | 1 | 5 | — | — | — | 1 |
| 4 | 1-1-2-4 | 1-1-2 | 1 | 5 | — | 1 | — | — |
| 4 | 1-1-2-5 | 1-1-2 | 1 | 5 | — | — | 1 | — |
| 4 | 1-1-2-6 | 1-1-2 | 1 | 5 | — | — | — | 1 |
| 4 | 1-2-1-1 | 1-2-1 | 0.5 | 15 | — | — | — | — |
| 4 | 1-2-1-2 | 1-2-1 | 0.5 | 15 | 1 | — | — | — |
| 4 | 1-3-1-1 | 1-3-1 | 0.5 | 15 | — | — | — | — |
| 4 | 2-1-1-1 | 2-1-1 | 0.5 | 12 | — | — | — | — |
| 4 | 2-1-2-1 | 2-1-2 | 0.1 | 12 | — | — | — | — | assayed against biotinylated hIL-6. Obtained values were analyzed using Graph Pad Prism 5 and non-linear regression.

Results

Second Phage Display Selection of Maturated IL-6 Binding Z Variants:

Selection was performed in 17 parallel tracks in total, each track containing four cycles. The selection tracks differed in target concentration, selection time and wash conditions as outlined in Table 11.

Sequencing of Potential Binders:

Randomly picked clones were sequenced. Each individual Z variant was given an identification number, Z #####, as described in Example 1. In total, 707 new unique Z variant molecules were identified. The amino acid sequences of 58 residues long Z variants are listed in FIG. 1 and in the sequence listing as SEQ ID NO:1-6, SEQ ID NO:8-14, SEQ ID NO:90-150 and SEQ ID NO:872-1502. The deduced IL-6 binding motifs (BM) extend from position 8 to position 36 in each sequence. The amino acid sequences of the 49 amino acid residues long polypeptides predicted to constitute the complete three-helix bundle within each of these Z variants (BMod) extend from position 7 to position 55.

ELISA Screening of Z Variants:

Clones obtained after four selection cycles were produced in 96-well plates and screened for human IL-6 binding activity using ELISA. All randomly picked clones were analyzed. 705 of the 707 unique Z variants were found to give a response of 3× the negative controls or higher (0.3-2.3 AU) against hIL-6 at a concentration of 0.25 nM. Positive signals were shown for clones originating from all selection tracks. The average response of the negative controls on the plates was 0.085 AU.

ELISA EC50 Analysis of IL-6 Binders:

A subset of Z variants was selected based on the result in the ELISA experiment described above. All Z variants exhibiting an absorbance of over 1.6 AU or a response over 1.7 after normalizing the response against the average response of the duplicate positive control Z06814 (SEQ ID NO:1512) on each plate were subjected to a target titration in ELISA format as described in Example 4. Periplasm samples with the maturated binder Z11632 (SEQ ID NO:7) as well as the primary binder Z06814 (SEQ ID NO:1512) were also assayed as positive controls. Obtained values were analyzed and their respective EC50 values were calculated (Table 12).

TABLE 12

Calculated EC50 values from ELISA titration analysis of Z variants from the second maturation as well as positive controls Z06814 and Z11632

| Z variant | SEQ ID NO | EC50 ELISA (M) |
|---|---|---|
| Z14521 | 90 | $2.3 \times 10^{-10}$ |
| Z14524 | 91 | $2.7 \times 10^{-10}$ |
| Z14525 | 92 | $2.5 \times 10^{-10}$ |
| Z14538 | 93 | $3.2 \times 10^{-10}$ |
| Z14547 | 94 | $2.5 \times 10^{-10}$ |
| Z14550 | 95 | $2.7 \times 10^{-10}$ |
| Z14551 | 96 | $2.6 \times 10^{-10}$ |
| Z14556 | 97 | $2.8 \times 10^{-10}$ |
| Z14559 | 98 | $2.3 \times 10^{-10}$ |
| Z14596 | 99 | $2.4 \times 10^{-10}$ |
| Z14609 | 100 | $3.0 \times 10^{-10}$ |
| Z14614 | 101 | $3.8 \times 10^{-10}$ |
| Z14620 | 102 | $3.1 \times 10^{-10}$ |
| Z14630 | 6 | $2.5 \times 10^{-10}$ |
| Z14634 | 103 | $2.3 \times 10^{-10}$ |
| Z14645 | 104 | $2.5 \times 10^{-10}$ |
| Z14651 | 105 | $2.4 \times 10^{-10}$ |
| Z14662 | 106 | $2.7 \times 10^{-10}$ |
| Z14673 | 107 | $2.3 \times 10^{-10}$ |
| Z14700 | 8 | $2.4 \times 10^{-10}$ |
| Z14706 | 108 | $2.3 \times 10^{-10}$ |
| Z14710 | 109 | $2.6 \times 10^{-10}$ |
| Z14712 | 9 | $2.6 \times 10^{-10}$ |
| Z14720 | 110 | $2.2 \times 10^{-10}$ |
| Z14722 | 111 | $3.2 \times 10^{-10}$ |
| Z14731 | 112 | $2.1 \times 10^{-10}$ |
| Z14746 | 113 | $2.8 \times 10^{-10}$ |
| Z14765 | 114 | $2.7 \times 10^{-10}$ |
| Z14767 | 115 | $2.4 \times 10^{-10}$ |
| Z14782 | 116 | $2.4 \times 10^{-10}$ |
| Z14783 | 117 | $2.4 \times 10^{-10}$ |
| Z14784 | 118 | $2.5 \times 10^{-10}$ |
| Z14788 | 119 | $3.0 \times 10^{-10}$ |
| Z14829 | 120 | $2.7 \times 10^{-10}$ |
| Z14861 | 4 | $2.3 \times 10^{-10}$ |
| Z14862 | 10 | $2.2 \times 10^{-10}$ |
| Z14867 | 121 | $2.6 \times 10^{-10}$ |
| Z14868 | 122 | $2.8 \times 10^{-10}$ |
| Z14878 | 123 | $2.9 \times 10^{-10}$ |
| Z14888 | 124 | $2.2 \times 10^{-10}$ |
| Z14929 | 125 | $2.1 \times 10^{-10}$ |
| Z14944 | 126 | $1.9 \times 10^{-10}$ |
| Z14976 | 1 | $1.6 \times 10^{-10}$ |
| Z14984 | 5 | $1.6 \times 10^{-10}$ |
| Z14990 | 127 | $2.5 \times 10^{-10}$ |
| Z14992 | 128 | $2.8 \times 10^{-10}$ |
| Z15003 | 129 | $3.0 \times 10^{-10}$ |
| Z15015 | 2 | $1.8 \times 10^{-10}$ |
| Z15024 | 130 | $3.1 \times 10^{-10}$ |
| Z15025 | 131 | $2.1 \times 10^{-10}$ |
| Z15031 | 132 | $2.1 \times 10^{-10}$ |
| Z15036 | 11 | $2.4 \times 10^{-10}$ |
| Z15042 | 133 | $2.2 \times 10^{-10}$ |
| Z15053 | 134 | $2.4 \times 10^{-10}$ |
| Z15057 | 135 | $2.3 \times 10^{-10}$ |
| Z15067 | 136 | $2.2 \times 10^{-10}$ |
| Z15079 | 137 | $2.1 \times 10^{-10}$ |
| Z15082 | 138 | $2.2 \times 10^{-10}$ |
| Z15097 | 139 | $2.2 \times 10^{-10}$ |
| Z15102 | 140 | $2.1 \times 10^{-10}$ |
| Z15110 | 12 | $2.0 \times 10^{-10}$ |
| Z15111 | 141 | $2.3 \times 10^{-10}$ |
| Z15117 | 142 | $2.1 \times 10^{-10}$ |
| Z15122 | 3 | $1.7 \times 10^{-10}$ |
| Z15126 | 13 | $1.5 \times 10^{-10}$ |
| Z15129 | 143 | $2.1 \times 10^{-10}$ |
| Z15140 | 144 | $2.1 \times 10^{-10}$ |
| Z15141 | 145 | $2.3 \times 10^{-10}$ |
| Z15142 | 14 | $1.6 \times 10^{-10}$ |
| Z15145 | 146 | $2.3 \times 10^{-10}$ |
| Z15151 | 147 | $1.9 \times 10^{-10}$ |
| Z15159 | 148 | $1.8 \times 10^{-10}$ |
| Z15162 | 149 | $1.8 \times 10^{-10}$ |
| Z15164 | 150 | $2.0 \times 10^{-10}$ |
| Z06814 | 1512 | $3.2 \times 10^{-10}$ |
| Z11632 | 7 | $2.5 \times 10^{-10}$ |

Example 7

Subcloning, Production and Characterization of a Subset of IL-6 Binding Z Variants In this Example, a subset of affinity-matured IL-6 binding Z variants were produced and functionally assessed by SPR, ELISA, cell-based assays and CD. SPR was used for measuring the kinetic parameters of Z variants interacting with IL-6. Competition ELISA was applied to investigate the binding mode of Z variants to human IL-6 protein. A TF-1 cell-based assay was applied to assess the ability of Z variants to block IL-6 dependent signaling. CD was used to investigate the secondary structure of the Z variants and determine their melting temperatures.

Materials and Methods

Subcloning of Z Variants into Expression Vectors:

The DNA of 14 IL-6 binding Z variants, Z11632 (SEQ ID NO:7), Z14630 (SEQ ID NO:6), Z14700 (SEQ ID NO:8), Z14712 (SEQ ID NO:9), Z14861 (SEQ ID NO:4), Z14862 (SEQ ID NO:10), Z14976 (SEQ ID NO:1), Z14984 (SEQ ID NO:5), Z15015 (SEQ ID NO:2), Z15036 (SEQ ID NO:11), Z15110 (SEQ ID NO:12), Z15122 (SEQ ID NO:3), Z15126 (SEQ ID NO:13) and Z15142 (SEQ ID NO:14), was amplified from the library vector pAY02592. The subcloning was performed as described in Example 2. The Z gene fragments were subcloned into the expression vector pAY01448 resulting in the encoded sequence MGSSHHHHHHLQ-[Z #####]-VD (SEQ ID NO:1598).

Protein Expression and Purification Under Denatured Conditions:

E. coli ROSETTA cells (Novagen) were transformed with plasmids containing the gene fragment of each respective IL-6 binding Z variant and cultivated at 37° C. in 100 ml of TSB-YE medium supplemented with 50 µg/ml kanamycin. Expression was induced at $OD_{600}$=0.8 by addition of IPTG at a final concentration of 1 mM and the cultures were incubated at 25° C. for another 16-20 h. The cells were harvested by centrifugation.

Protein purification was performed under denatured conditions essentially as described in Example 2. Protein concentrations were determined by measuring the absorbance at 280 nm, using the extinction coefficient of the respective protein. The purity of the IL-6 binding Z variants was analyzed by SDS-PAGE stained with Coomassie Blue.

Protein Expression and Purification Under Native Conditions:

E. coli BL21 (DE3) cells (NEB, cat. no. C2527I) were transformed with plasmids containing gene fragments of matured variants Z11632 (SEQ ID NO:7), Z14630 (SEQ ID NO:6), Z14700 (SEQ ID NO:8), Z14712 (SEQ ID NO:9), Z14861 (SEQ ID NO:4), Z14862 (SEQ ID NO:10), Z14976 (SEQ ID NO:1), Z14984 (SEQ ID NO:5), Z15015 (SEQ ID NO:2), Z15036 (SEQ ID NO:11), Z15110 (SEQ ID NO:12), Z15122 (SEQ ID NO:3), Z15142 (SEQ ID NO:14), of the primary Z variant Z06814 (SEQ ID NO:1512), as well as of the control Z variant Z04726 (SEQ ID NO:1553). Transformed bacterial cells were cultivated at 37° C. in 1000 ml of LB medium supplemented with 50 µg/ml kanamycin. In order to induce protein expression, IPTG was added to a final concentration of 0.1 mM at $OD_{600}$=0.8 and the cultures were incubated at 25° C. for 17 h. The cells were harvested by centrifugation at 4° C. and 8000 rpm for 30 min. Supernatants were discarded and cell pellets re-suspended in 10 ml PBS. After cell disruption by sonication, cell debris was removed by centrifugation and each supernatant was applied on 2 ml Ni-NTA columns (QIAGEN, cat. no. 30410) equilibrated with 20 ml wash buffer (20 mM $NaH_2PO_4$, 10 mM NaCl, 20 mM imidazole, pH 6.0). Contaminants were removed by washing with wash buffer, and Z variants were eluted with elution buffer (20 mM $NaH_2PO_4$, 10 mM NaCl, 250 mM imidazole, pH 6.0). The eluents were subjected to purification on an ion exchange column (Life Technologies, cat. no. 4481317), and Z variants were eluted by an increasing salt concentration. Buffer solutions of eluents were then changed to PBS (10 mM $Na_2HPO_4$, 1.8 mM $KH_2PO_4$, 137 mM NaCl, 2.7 mM KCl) using a VIVASPIN 6 column (Sartorius, cat. no. VS0691). The purity of Z variants was analyzed by SDS-PAGE stained with Coomassie Blue.

PROTEON Kinetic Analysis:

Kinetic constants ($k_{on}$ and $k_{off}$) and affinities ($K_D$) for human IL-6 were determined for 6 $His_6$-tagged Z variants purified under denatured conditions. The IL-6 binding variants Z06814 (SEQ ID NO:1512), Z14861 (SEQ ID NO:4), Z014976 (SEQ ID NO:1), Z14984 (SEQ ID NO:5), Z15015 (SEQ ID NO:2), and Z15122 (SEQ ID NO:3) were diluted to 5 µg/ml in 10 mM NaAc buffer, pH 4.5, and immobilized separately on GLC chip (Bio-Rad, cat. no. 176-5011). The immobilization was performed using amine coupling chemistry according to the manufacturer's recommendations and PBST 0.05% was used as running buffer. PBST 0.05% was also used as running buffer in the kinetic experiment using a flow rate was 60 µl/min. The analyte hIL-6 was diluted in the PBST 0.05% running buffer to final concentrations of 50 nM, 12.5 nM, 3.1 nM, 0.78 nM, 0.19 nM and 0 nM and injected in triplicate for 3 min, followed by dissociation in running buffer for 90 min. After dissociation, the surfaces were regenerated with HCl supplemented with 0.05% Tween 20. Kinetic constants were calculated from the sensorgrams using a 1:1 model in Bio-Rad manager Software (Bio-Rad).

Analysis of Binding Site:

The interference of 14 maturated IL-6 binding Z variants (purified under denatured conditions) with the interaction between human gp130 (hgp130) and hIL-6/hIL-6Rα was assessed as described in Example 2. The primary binder Z06814 and the hIL-6Rα binding antibody tocilizumab, were included for comparison.

TF-1 Cell-Based Assay:

TF-1 cells were cultured in RPMI1640 with L-glutamine (HyClone, cat. no. SH30027) supplemented with 10% FBS (HyClone, cat. no. SH30919.03), Pen-Strep (HyClone, cat. no. 15140-163) and 2 ng/ml rhGM-CSF (R&D Systems, cat. no. 215-GM-010). Prior to use, cells were washed twice in RPMI-1640 in absence of rhGM-CSF. Cells were then counted and dispensed into a 96-well plate (Corning, cat. no. 3596) at a density of $4 \times 10^4$ cells per well. In separate plates, serial dilutions (concentration range 10-0.00061 nM) of Z variants (purified under native conditions), tocilizumab (Roche) and control IgG (Jackson Immunoresearch, cat. no. Jac-009-000-003) were incubated in the presence of 0.099 nM rhIL-6 (R&D Systems, cat. no. 206-IL/CF). These pre-mixtures were then transferred to wells containing TF-1 cells, which were incubated for 72 h at 37° C. in a humidified 5% $CO_2$ atmosphere. During the last four hours of incubation, 10 µl of WST (DoGen, cat. no. EZ3000) were included per well. The absorbance was measured at 450 nM using a Victor X3 plate reader (Perkin Elmer). Relative cell viability was calculated by dividing the absorbance of each well by the mean absorbance of IL-6-treated wells in each plate. The data was assessed by non-linear regression to a four-parameter dose-response curve, and the half-maximal inhibitory concentration (IC50) was determined using Graphpad Prism software.

CD Analysis:

CD analysis was performed as described in Example 2 using Z variants purified under native conditions.

Results

PROTEON Kinetic Analysis:

The interactions of 6 His$_6$-tagged IL-6-binding Z variants with human IL-6 were analyzed in a ProteOn instrument by injecting various concentrations of the hIL-6 over surfaces containing different immobilized Z variants. The ligand immobilization levels of the surfaces were between 100-220 RU each. A summary of the kinetic parameters ($K_D$, $k_a$ ($k_{on}$) and $k_d$ ($k_{off}$)) for binding of hIL-6 to the Z variants using a 1:1 interaction model is given in Table 13.

TABLE 13

Kinetic parameters for binding of hIL-6 to Z variants

| Z variant | SEQ ID NO: | $k_{on}$ (M$^{-1}$s$^{-1}$) | $k_{off}$ (s$^{-1}$) | $K_D$ (M) |
|---|---|---|---|---|
| His$_6$-Z06814 | 1512 | $4.3 \times 10^5$ | $8.8 \times 10^{-5}$ | $2.0 \times 10^{-10}$ |
| His$_6$-Z14861 | 4 | $3.6 \times 10^5$ | $6.3 \times 10^{-5}$ | $1.7 \times 10^{-10}$ |
| His$_6$-Z14976 | 1 | $3.1 \times 10^5$ | $2.7 \times 10^{-5}$ | $8.8 \times 10^{-11}$ |
| His$_6$-Z14984 | 5 | $3.0 \times 10^5$ | $7.4 \times 10^{-5}$ | $2.5 \times 10^{-10}$ |
| His$_6$-Z15015 | 2 | $4.3 \times 10^5$ | $7.2 \times 10^{-5}$ | $1.7 \times 10^{-10}$ |
| His$_6$-Z15122 | 3 | $3.1 \times 10^5$ | $3.9 \times 10^{-5}$ | $1.2 \times 10^{-10}$ |

Figure 5:
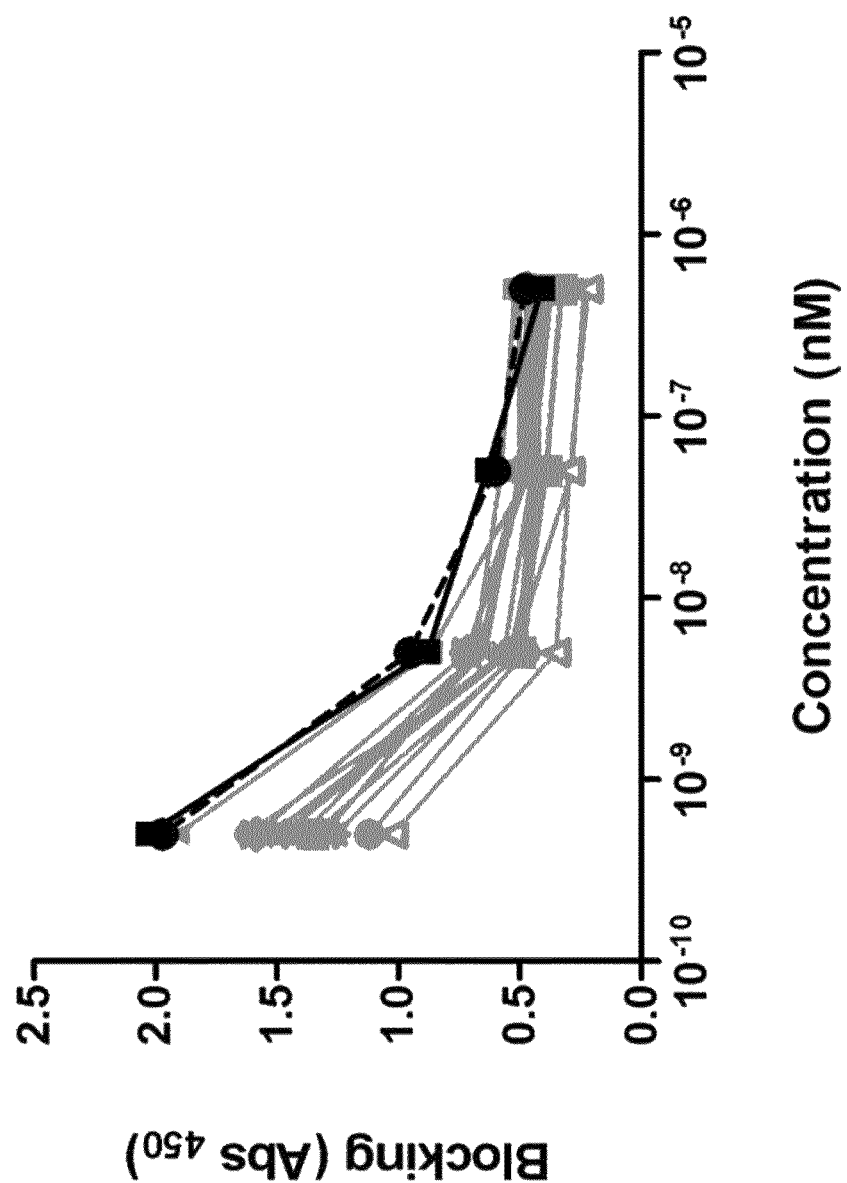
FIG. 5 shows the result of blocking of the binding of pre-mixed hIL-6/hIL-6Rα to hgp130, assayed as described in Example 7. Concentration dependent blocking was seen for all tested maturated IL-6 binding Z variants (gray) as well as for tocilizumab (black) and the primary binder Z06814 (SEQ ID NO:1512, broken line), which were both included for comparison. All maturated IL-6 binding Z variants showed more efficient blocking than the primary binders assayed in Example 2 (compare FIG. 3).

Analysis of Binding Site:

All maturated IL-6 binding Z variants showed a clear concentration-dependent blocking of the trans-signaling resembling interaction between preformed hIL-6/hIL-6Rα and hgp130 (FIG. 5). Each maturated Z variant showed a higher blocking capacity than both the primary binder Z06814 and tocilizumab, i.e. which would correspond to IC50 values less than 1.6 nM.

Figure 6:
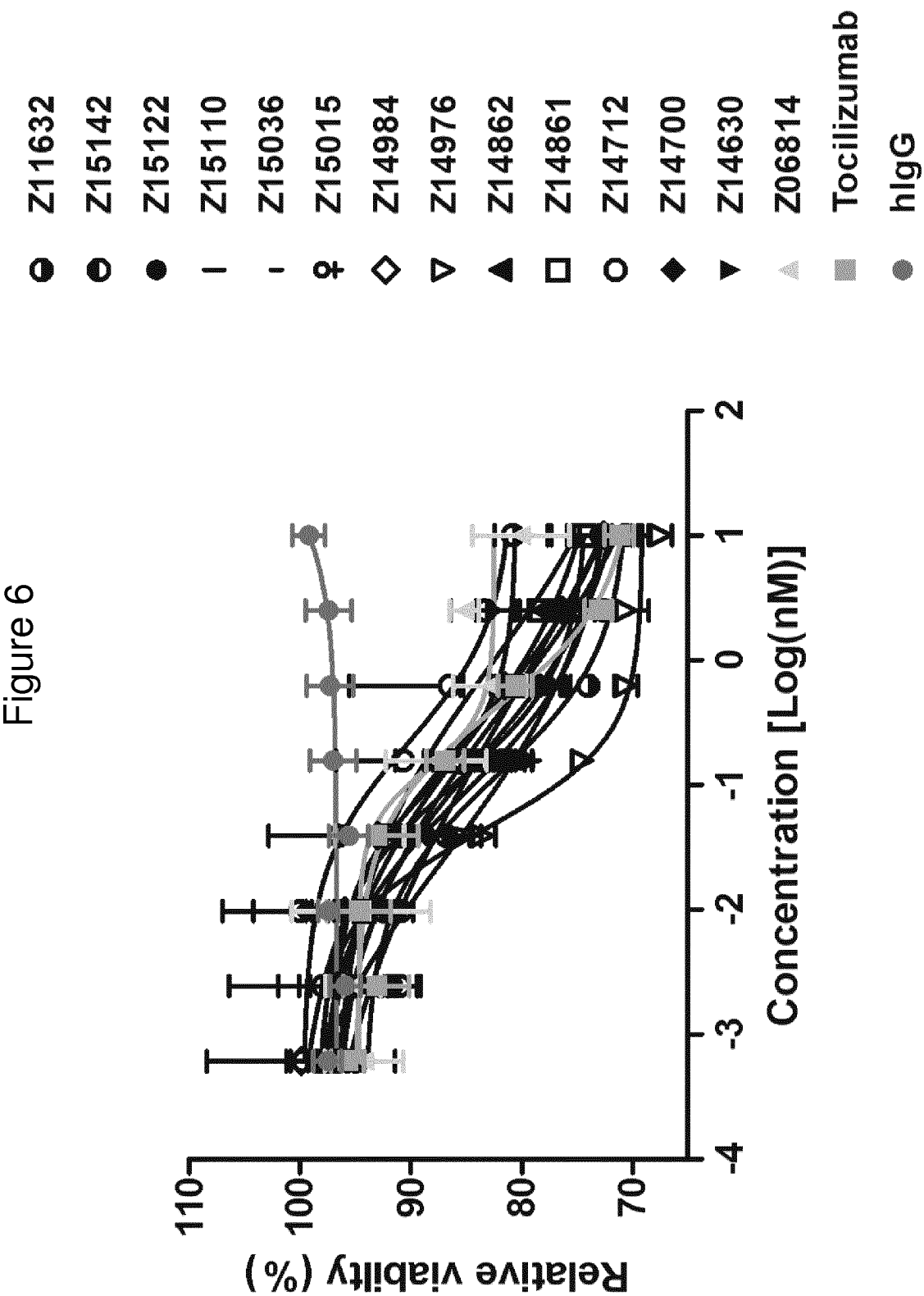
FIG. 6 shows the result of the TF-1 cell neutralizing assay described in Example 7. Concentration dependent inhibition of IL-6 induced TF-1 cell proliferation was seen for all tested IL-6 binding Z variants (matured Z variants shown in black; primary binder Z06814 (SEQ ID NO:1512) shown as grey filled triangles) and for tocilizumab (grey filled squares), but not for the negative control antibody hIgG (grey filled circles).

TF-1 Cell-Based Assay:

A TF-1 cell-based assay was conducted to evaluate the efficacy and potency of IL-6 binding Z variants in the classical signaling pathway. This assay showed that all affinity-matured IL-6 binding Z variants were capable of blocking IL-6 dependent growth of the TF-1 cells (FIG. 6). The calculated IC50 values for Z variants and for the hIL-6Rα binding antibody tocilizumab are shown in Table 14.

TABLE 14

IC50 values for matured Z variants blocking the IL-6 dependent growth of TF-1 cells

| Z variant | SEQ ID NO: | IC50 (M) |
|---|---|---|
| His$_6$-Z11632 | 7 | $1.2 \times 10^{-10}$ |
| His$_6$-Z14630 | 6 | $8.7 \times 10^{-11}$ |
| His$_6$-Z14700 | 8 | $1.0 \times 10^{-10}$ |
| His$_6$-Z14712 | 9 | $2.2 \times 10^{-10}$ |
| His$_6$-Z14861 | 4 | $1.9 \times 10^{-10}$ |
| His$_6$-Z14862 | 10 | $4.3 \times 10^{-10}$ |
| His$_6$-Z14976 | 1 | $4.2 \times 10^{-11}$ |
| His$_6$-Z14984 | 5 | $2.7 \times 10^{-10}$ |
| His$_6$-Z15015 | 2 | $2.7 \times 10^{-11}$ |
| His$_6$-Z15036 | 11 | $1.8 \times 10^{-10}$ |
| His$_6$-Z15110 | 12 | $9.3 \times 10^{-10}$ |
| His$_6$-Z15122 | 3 | $8.5 \times 10^{-11}$ |
| His$_6$-Z15142 | 14 | $5.1 \times 10^{-10}$ |
| His$_6$-Z06814 | 1512 | $1.3 \times 10^{-10}$ |
| tocilizumab | N/A | $4.1 \times 10^{-10}$ |

CD Analysis:

The CD spectra determined for 10 matured Z variants showed that each one had an α-helical structure at 20° C. The melting temperatures (Tm) determined by variable temperature measurement are shown in Table 15.

TABLE 15

Melting temperatures for a subset of matured Z variants

| Z variant | SEQ ID NO: | Tm (° C.) |
|---|---|---|
| His$_6$-Z11632 | 7 | 51 |
| His$_6$-Z14630 | 6 | 57 |
| His$_6$-Z14700 | 8 | 53 |
| His$_6$-Z14712 | 9 | 55 |
| His$_6$-Z14861 | 4 | 48 |
| His$_6$-Z14862 | 10 | 53 |
| His$_6$-Z15015 | 2 | 56 |
| His$_6$-Z15036 | 11 | 59 |
| His$_6$-Z15110 | 12 | 50 |
| His$_6$-Z15142 | 14 | 53 |

Example 8

In Vivo Activity of IL-6 Binding Z Variants in Fusion with ABD

A Serum Amyloid A (SAA) mouse model was used in order to explore the in vivo blocking effect of the IL-6 binding Z variants in fusion with ABD. The acute phase protein SAA is secreted from liver cells and can be induced by the proinflammatory cytokines IL-1, IL-6 and TNF. Due to the sequence homology of the human and mouse cytokines, the human variants are able to act on their corresponding mouse receptors and induce a murine SAA response. Note, that the human TNF protein is only able to interact with murine TNFRII (not murine TNFRI).

Materials and Methods

The IL-6 targeting Z variant Z06814 (SEQ ID NO:1512) and a control Z variant Z04726 (SEQ ID NO:1535) binding an irrelevant target, were cloned and produced in fusion with the ABD variant PP013 (SEQ ID NO:1554) as described in Example 2. Four groups of Balb/c mice (n=8) were injected subcutaneously (s.c.) with various doses (0, 0.025, 2.5 or 25 mg/kg body weight) of Z06814-ABD 9 h prior to intraperitoneal (i.p.) administration of hIL-6 at 5 µg/kg (R&D Systems). A fifth group of mice (n=8) received 25 mg/kg of Z04726-ABD. Two additional control groups of mice received PBS (n=4) and 25 mg/kg of Z06814-ABD (n=8), respectively, but no subsequent IL-6 injection. After 20 h, the blood was taken by cardiac puncture and serum was collected.

Serum was assessed for the content of murine SAA by ELISA (Tridelta) according to the manufacturer's instructions. In brief, diluted serum samples were added to SAA-precoated plates together with anti-SAA-HRP. The plates were incubated for 1 h and then washed four times. TMB substrate was added for 20 min and the reaction was stopped with stop solution. The absorbance was measured at 450 nm using a microplate reader (VICTOR$^3$, Perkin Elmer).

Results

Figure 7:
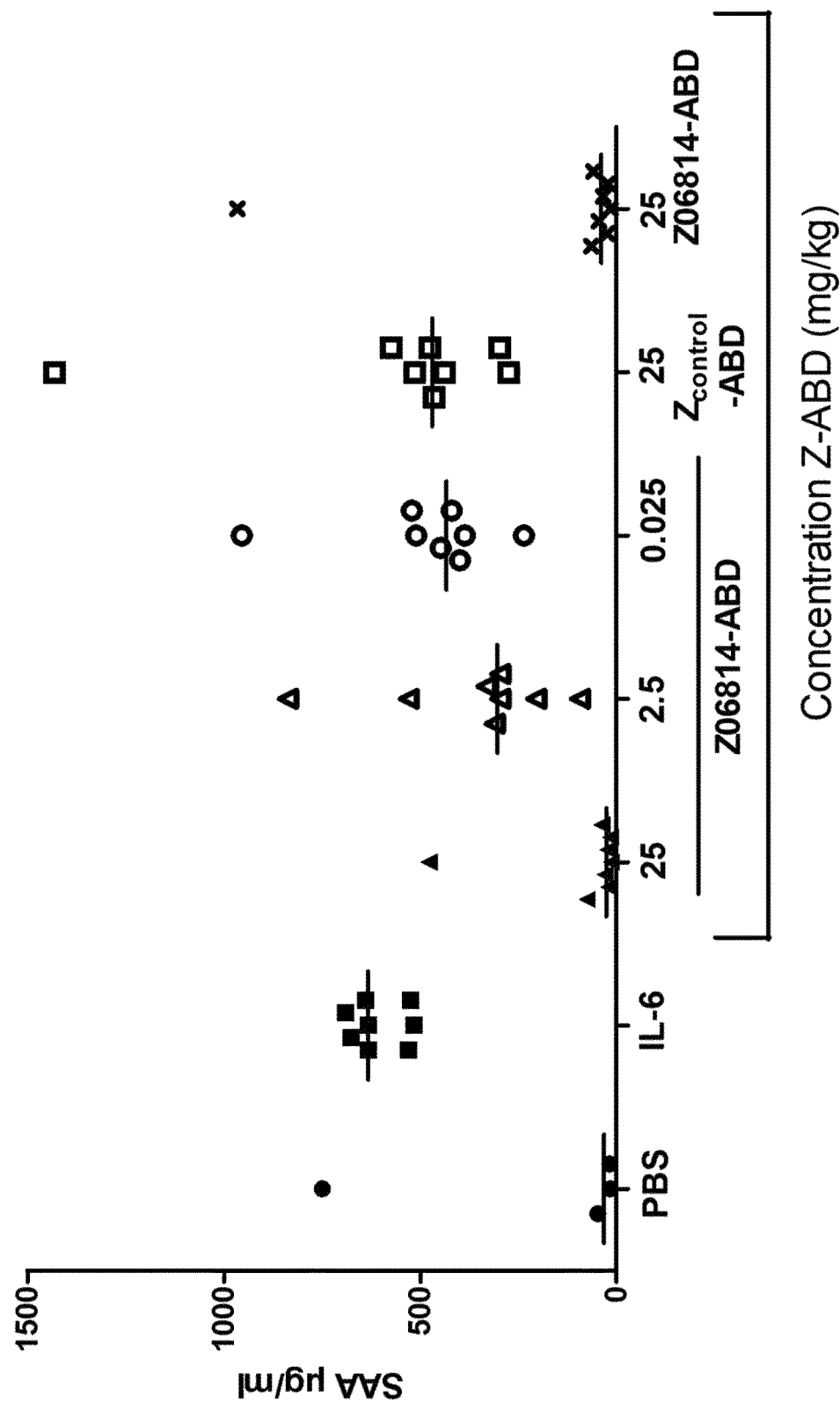
FIG. 7 shows the in vivo efficacy of the Z variant Z06814 (SEQ ID NO:1512) in fusion with the ABD variant PP013 (SEQ ID NO:1554) as scored by assaying IL-6 triggered serum amyloid-A (SAA) protein release in an anti-arthritic mouse model as described in Example 8. Four groups of mice were given 0 (filled squares), 0.025 (open dots), 2.5 (open triangles) or 25 (closed triangles) mg/kg body weight of the IL-6 binding Z06814-ABD fusion protein. As a control, mice were given 25 mg/kg of a control Z variant (Z04726; SEQ ID NO:1553) in fusion with ABD (referred to as $Z_{control}$-ABD) (open squares). Mice were injected with hIL-6 and subsequently the levels of SAA protein were measured. Two additional control groups of mice received PBS (filled circles) and 25 mg/kg Z06814-ABD (crosses), respectively, but no subsequent IL-6 injection.

The anti-arthritic efficacy of the Z variant Z06814 (SEQ ID NO:1512) was assessed in vivo using a mouse model for IL-6 triggered serum amyloid-A (SAA) protein release. Four groups of mice were given 0, 0.025, 2.5 or 25 mg/kg body weight of the IL-6 binding Z06814-ABD fusion protein or 25 mg/kg of a control Z04726-ABD fusion protein 9 h before an injection of 5 µg/kg body weight of hIL-6. After an additional 22 h, the levels of SAA protein were measured and compared between the different groups. In animals receiving either no Z06814-ABD or 25 mg/kg of the control Z04726-ABD fusion, SAA protein levels in serum increased to levels of approximately 500-600 µg/ml. Control animals given PBS only (and no hIL-6) exhibited levels in the range of 16-64 µg/ml. In animals given Z06814-ABD, significantly lower SAA protein levels were measured in a dose-dependent manner (FIG. 7). For the group given the highest dose of Z06814-ABD (25 mg/kg body weight), SAA protein levels were as low as for animals given no hIL-6 injection.

Example 9

Production of Complexes and Control Polypeptides

Materials and Methods

Production of Antibodies and Complexes:

Four different complexes targeting IL-6 and TNF were constructed, as well as an antibody with affinity for TNF. An antibody denoted "Ada", having the same CDR sequences and specificity as the commercially available monoclonal antibody adalimumab, was constructed using the heavy chain (HC) and light chain (LC) sequences $HC_{Ada}$ (SEQ ID NO:1557) and $LC_{Ada}$ (SEQ ID NO:1558). The IL-6 targeting Z variant Z06814 (SEQ ID NO:1512) moiety, but starting with the amino acid residues AE instead of VD and with the additional C-terminal amino acid residues VD, was genetically fused, via a flexible 15 residue (GGGGS)$_3$ (SEQ ID NO:1595) linker, to the N-termini of $HC_{Ada}$ or $LC_{Ada}$, resulting in the complexes denoted Z06814-$HC_{Ada}$ and Z06814-$LC_{Ada}$, respectively, or to the C-termini of the same chains, resulting in the complexes $HC_{Ada}$-Z06814 and $LC_{Ada}$-Z06814, respectively. Gene synthesis, cloning, production by transient gene expression in CHO cells and purification using Protein A affinity chromatography was performed by Evitria AG (Switzerland). The purity of the complexes and of Ada was analyzed by SDS-PAGE under both non-reduced and reduced conditions. 15 µg of each variant was loaded on a 12-well 4-12% NUPAGE gel (Life Technologies).

Production of Control Polypeptides:

A subcloning strategy for construction of the IL-6 binding Z variant Z06814 (SEQ ID NO:1512) and a Z variant binding an irrelevant target, Z04726 (SEQ ID NO:1553), with an N-terminal His$_6$ tag, was applied using standard molecular biology techniques (essentially as described in detail in WO2009/077175 for Z variants binding another target). The Z gene fragment was subcloned into the expression vector pAY01448, resulting in the encoded sequence MGSSHHHHHHLQ-[Z #####]-VD (SEQ ID NO:1598).

Z06814 was also subcloned in fusion with the albumin binding domain variant PP013 (SEQ ID NO:1554). The construct encoded by the expression vector was MGSSLQ-[Z #####]-VDGS-PP013 (SEQ ID NO:1599).

E. coli BL21(DE3) cells (Novagen) were transformed with plasmids containing the gene fragments of each respective Z variant, cultivated at 37° C. in TSB-YE medium supplemented with 50 µg/ml kanamycin. Protein expression was induced with IPTG. Pelleted cells were disrupted by sonication and the cell debris was removed by centrifugation. Each supernatant containing His$_6$ tagged protein or ABD fused protein was purified by affinity chromatography using GraviTrap IMAC column (GE Healthcare, cat. no. 11-0033-99) or anti-ABD agarose (WO2014064237), respectively. The ABD fused Z variant was also purified on a 1 ml Detoxi-Gel Endotoxin Removing Column (Pierce, cat. no. 20344). Next, buffer was exchanged to PBS (10 mM phosphate, 137 mM NaCl, 2.68 mM KCl, pH 7.4) for the purified Z variants. The purity of each sample was analyzed by SDS-PAGE stained with Coomassie Blue and the identity of each purified control Z variant was confirmed using LC/MS analysis.

Results

Figure 8:
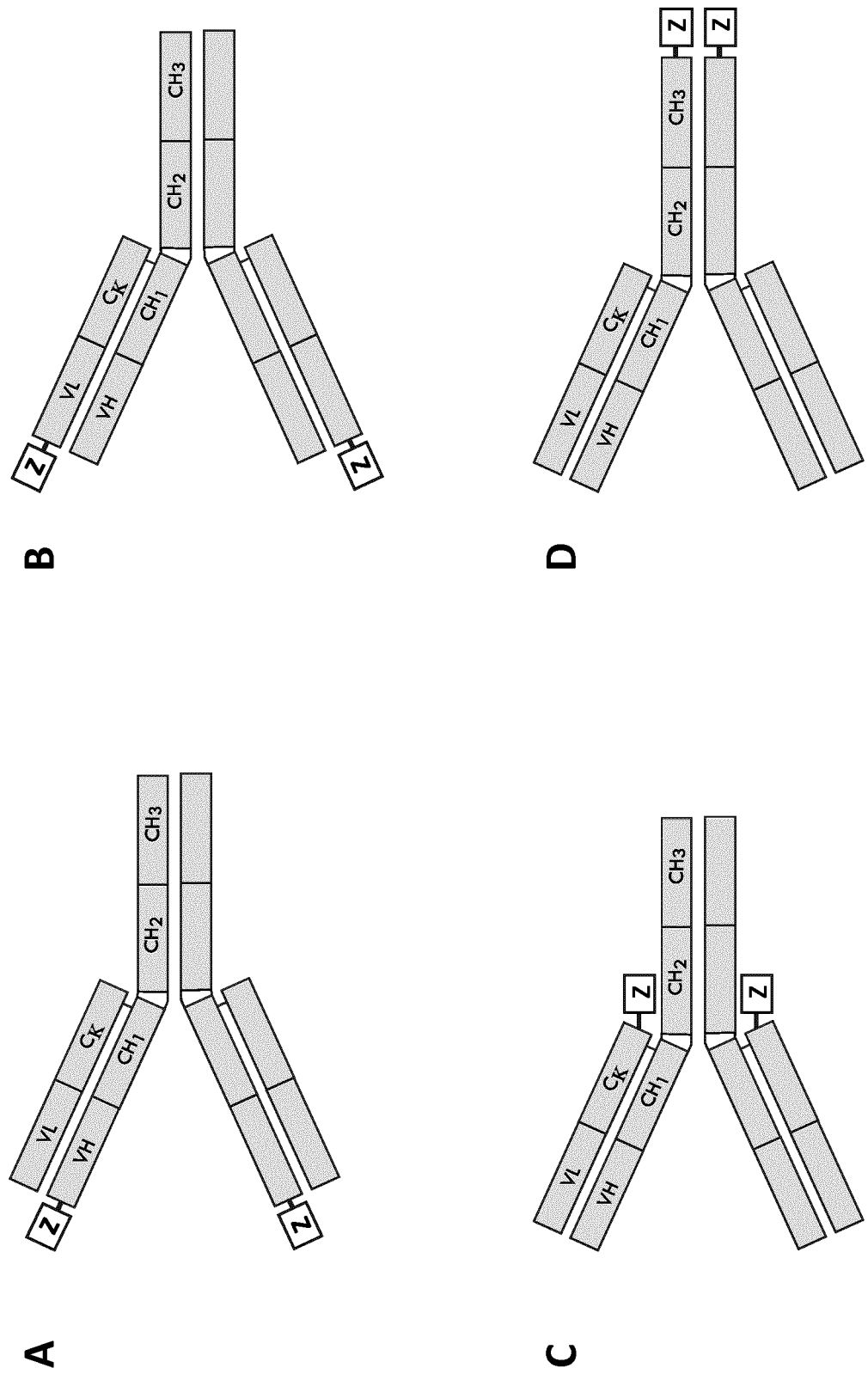
FIG. 8 shows a schematic representation of the design of four complexes according to the disclosure, produced as described in Example 9. "Z" denotes the IL-6 targeting Z variant Z06814 (SEQ ID NO:1512), which was genetically fused in all constructs to the anti-TNF monoclonal antibody Ada via a 15 residue (GGGGS)$_3$ (SEQ ID NO:1595)-linker. A) Z06814-HC$_{Ada}$: Z06814 fused to the N terminus of the heavy chain of Ada; B) Z06814-LC$_{Ada}$: Z06814 fused to the N terminus of the light chain of Ada; C) LC$_{Ada}$-Z06814: Z06814 fused to the C terminus of the light chain of Ada; and D) HC$_{Ada}$-Z06814: Z06814 fused to the C terminus of the heavy chain of Ada.
Figure 9:
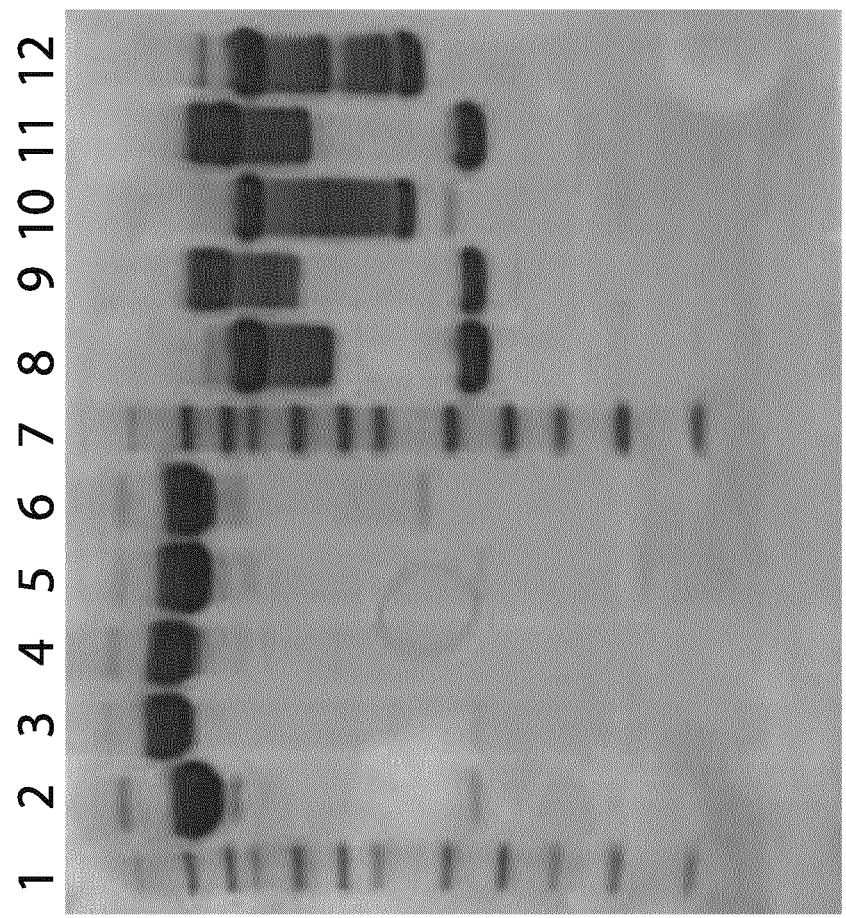
FIG. 9 shows the result of SDS-PAGE analysis of the complex variants shown in FIG. 7, produced in CHO cells and purified by protein A affinity chromatography. Lane 1: Novex Sharp Molecular weight standard (216, 160, 110, 80, 60, 50, 40, 30, 20, 15, 10, 3.5 kDa); lane 2: Ada (non-reduced); lane 3: Z06814-HC$_{Ada}$ (non-reduced); lane 4: Z06814-LC$_{Ada}$ (non-reduced); lane 5: HC$_{Ada}$-Z06814 (non-reduced); lane 6: LC$_{Ada}$-Z06814 (non-reduced); lane 7: Molecular weight standard as in lane 1; lane 8: Ada (reduced); lane 9: Z06814-HC$_{Ada}$ (reduced); lane 10: Z06814-LC$_{Ada}$ (reduced); lane 11: HC$_{Ada}$-Z06814 (reduced) and lane 12: LC$_{Ada}$-Z06814 (reduced).

Production of Complex Constructs:

A schematic representation of the design of each of the four different produced complexes is shown in FIG. 8. Analysis by SDS-PAGE under non-reduced conditions of samples containing produced constructs showed that they were of high purity. SDS-PAGE analysis under reduced conditions confirmed the expected size of the individual subunits in concordance with the site of the fusion of the Z variant to the antibody chain (FIG. 9).

Production of Control Polypeptides:

The control polypeptides, constructed with an N-terminal His$_6$-tag or with a C-terminal ABD variant PP013, were produced in E. coli. SDS-PAGE analysis of each final protein preparation showed a high purity, and the correct identity and molecular weight of each control Z variant were confirmed by HPLC-MS analysis.

Example 10

Affinity Determinations of Complexes Binding to IL-6 and TNF

Materials and Methods

10 µg/ml solutions of each of the complexes Z06814-$HC_{Ada}$ and $LC_{Ada}$-Z06814, as well as of Ada and His$_6$-Z06814, i.e. each of the fusion partners alone, were prepared in 10 mM NaAc pH 4.5 buffer and used for immobilization of the proteins on a PROTEON GLC chip (Bio-Rad) via amine coupling chemistry. Immobilization levels obtained were ~1400-2000 RU for the two complexes and Ada, and 100-200 RU for His$_6$-Z06814. A series of 50 nM, 10 nM, 2 nM, 0.4 nM and 0.08 nM concentrations of rhIL-6 (R&D Systems) was injected and the responses recorded. This experiment was repeated three times.

In separate triplicate experiments, TNF (R&D Systems) was injected using the same concentration series. In all cases, the duration of the injection was 3 min at a flow rate of 60 µl/min and the dissociation time was 30 min. Buffer response levels obtained for activated/deactivated spots or in between spots areas were subtracted according to the manufacturer's instructions. The data was analyzed using Bio-Rad Manager Software (BioRad).

Results

The affinity to the two target proteins IL-6 and TNF were determined for the complexes Z06814-$HC_{Ada}$ and $LC_{Ada}$-Z06814, as well as of the individual subunits Ada and Z06814 alone. The kinetic parameters (($K_D$, $k_a$ ($k_{on}$) and $k_d$ ($k_{off}$)) for the interactions with IL-6 and TNF are summarized in Table 16 and 17, respectively.

TABLE 16

Kinetic parameters for binding of IL-6 to the indicated polypeptides.
Values shown are the average of three measurements ± standard deviation

| Polypeptide | $k_{on}$ (M$^{-1}$s$^{-1}$) | $k_{off}$ (s$^{-1}$) | $K_D$ (M) |
|---|---|---|---|
| Z06814-HC$_{Ada}$ | $3.2 \times 10^5 \pm 2.1 \times 10^3$ | $2.3 \times 10^{-4} \pm 2.8 \times 10^{-5}$ | $7.2 \times 10^{-10} \pm 8.4 \times 10^{-11}$ |
| LC$_{Ada}$-Z06814 | $1.4 \times 10^5 \pm 2.6 \times 10^3$ | $1.3 \times 10^{-4} \pm 1.6 \times 10^{-5}$ | $9.3 \times 10^{-10} \pm 1.2 \times 10^{-10}$ |
| His$_6$-Z06814 | $3.1 \times 10^5 \pm 4.5 \times 10^3$ | $1.5 \times 10^{-4} \pm 1.2 \times 10^{-5}$ | $5.0 \times 10^{-10} \pm 3.4 \times 10^{-11}$ |

TABLE 17

Kinetic parameters for binding of TNF to the indicated polypeptides.
Values shown are the average of three measurements ± standard deviation

| Polypeptide | $k_{on}$ (M$^{-1}$s$^{-1}$) | $k_{off}$ (s$^{-1}$) | $K_D$ (M) |
|---|---|---|---|
| Z06814-HC$_{Ada}$ | $6.2 \times 10^5 \pm 4.2 \times 10^3$ | $1.1 \times 10^{-4} \pm 0$ | $1.7 \times 10^{-10} \pm 1.7 \times 10^{-12}$ |
| LC$_{Ada}$-Z06814 | $8.4 \times 10^5 \pm 4.8 \times 10^3$ | $1.1 \times 10^{-4} \pm 1.9 \times 10^{-6}$ | $1.3 \times 10^{-10} \pm 2.8 \times 10^{-12}$ |
| Ada | $7.4 \times 10^5 \pm 5.6 \times 10^3$ | $1.6 \times 10^{-4} \pm 8.2 \times 10^{-7}$ | $2.2 \times 10^{-10} \pm 8.2 \times 10^{-13}$ |

The dissociation constant $K_D$ for the interaction of TNF with the produced Ada construct was determined to be 220 pM. For the Z06814-HC$_{Ada}$ and LC$_{Ada}$-Z06814 complexes, the observed $K_D$ values for TNF were 170 pM and 130 pM, respectively. This indicates that fusion of the Z variant to the antibody Ada did not negatively affect the antibody's affinity for TNF; rather, somewhat higher affinities were observed. When analyzed for binding to IL-6, the affinity of the complexes Z06814-HC$_{Ada}$ and LC$_{Ada}$-Z06814 differed only marginally from the affinity of His$_6$-Z06814 alone.

Example 11

Analysis of Biological Activity In Vitro

The potency of the four different complex variants constructed and produced as described in Example 9 was determined using a TF-1 cell assay, evaluating the classical signaling pathway. The TF-1 cell line proliferates in response to human IL-6, TNF and GM-CSF. This direct signaling of IL-6 to cell surface IL-6 receptor, in conjunction with a signaling receptor sub-unit called gp130, is termed cis-signaling. TF-1 cells were stimulated with either IL-6 or TNF alone or with both in combination.

Materials and Methods

TF-1 cells were cultured in RPMI1640 with L-glut (Lonza) supplemented with 10% FCS (Gibco), Pen-Strep (Lonza) and 2 ng/ml rhGM-CSF (R&D Systems). Prior to use, the cells were washed twice in RPMI1640 in the absence of rhGM-CSF. Cells were then counted and dispensed into 96 well flat bottomed plates at a density of 4×10$^4$ cells per well. In separate plates, serial dilutions (ranging either from 400-0.004 nM or 10-0.00001 nM) of the complexes Z06814-HC$_{Ada}$, Z06814-LC$_{Ada}$, HC$_{Ada}$-Z06814 and LC$_{Ada}$-Z06814; the negative control polypeptide Z04726 (SEQ ID NO:1553) with an N-terminal His$_6$-tag; the positive control polypeptides Z06814-ABD and Ada, and a mixture of Ada and Z06814-ABD were prepared. The samples were incubated in the presence of either 0.099 nM rhIL-6 (R&D Systems, cat. no. 206-IL/CF), 0.023 nM rhTNF (R&D Systems, cat. no. 210-TA) or a combination of both cytokines. The pre-mixtures were transferred to wells containing TF-1 cells which were incubated for 72 h at 37° C. in a humidified 5% CO$_2$ atmosphere. During the last four hours of incubation, 10 μl of CCK-8 (Fluka, Sigma Aldrich) was added per well to determine the number of proliferating cells. The absorbance was measured at 450 nm (Abs450) using a microplate reader (VICTOR$^3$, Perkin Elmer). The data on cell growth was assessed by non-linear regression to a four-parameter dose-response curve, and the half maximal inhibitory concentration (IC50) was determined using GraphPad Prism program. The inhibition of IL-6/TNF-dependent proliferation of TF-1 cells by the inhibitory molecules was as Abs450 minus control wells that contained cells but no IL-6.

Results

Figure 10A:
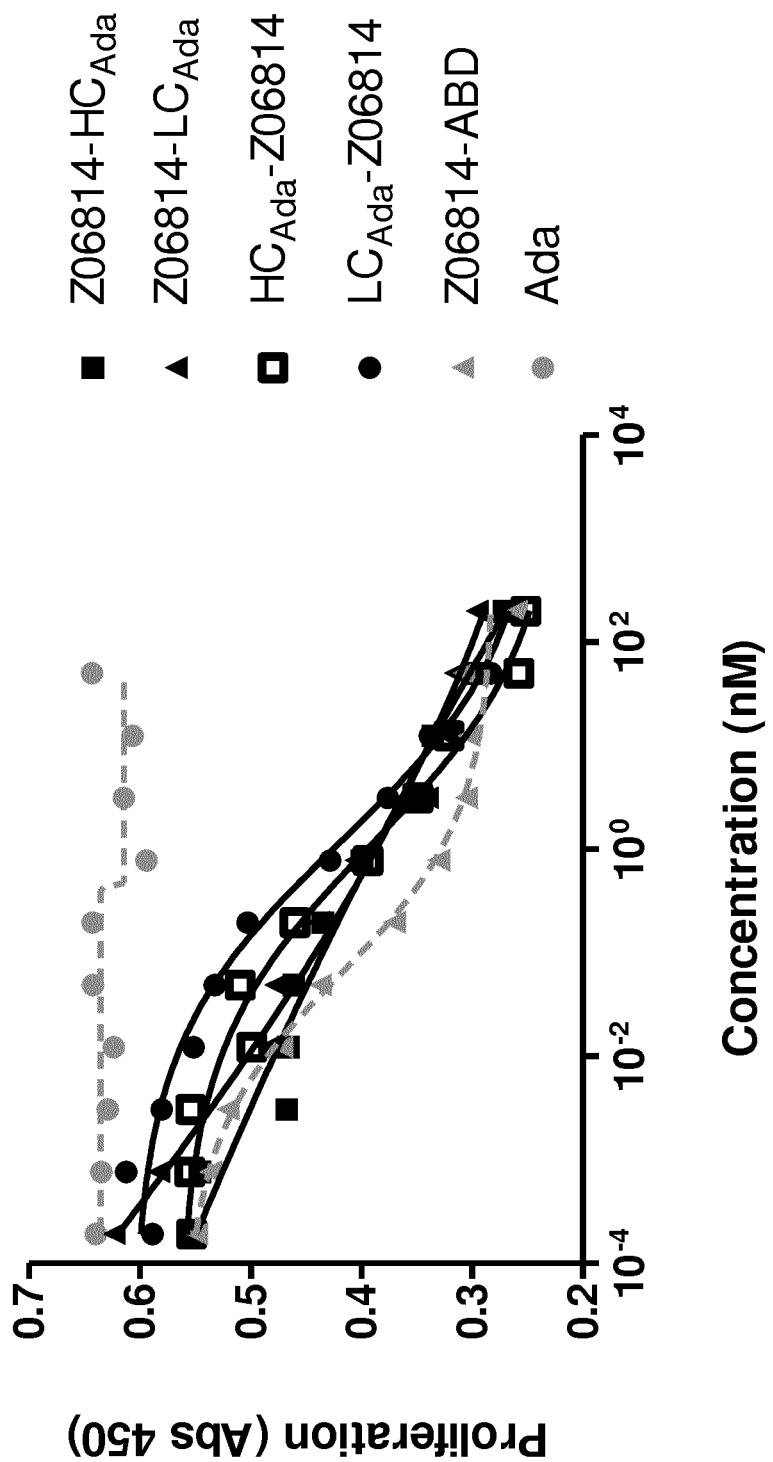
FIG. 10A-C shows the inhibition of TF-1 cell proliferation assayed as described in Example 11 and using constructs and comparators as indicated. A) TF-1 cells stimulated with IL-6, B) TF-1 cells stimulated with TNF, C) TF-1 cells stimulated with both IL-6 and TNF.

In a first set of experiments, the capacity of the four different complexes Z06814-HC$_{Ada}$, Z06814-LC$_{Ada}$, HC$_{Ada}$-Z06814 and LC$_{Ada}$-Z06814 to block either the hIL-6- or TNF-dependent growth of TF-1 cells was tested. As controls, Ada and Z06814-ABD alone were included. In the IL-6 blocking test, all four complexes, as well as the Z06814-ABD construct, showed growth inhibition capability with IC50 values estimated in the range from 0.1 to 1 nM. As expected, the TNF targeting Ada did not show any effect in this assay (FIG. 10A).

Figure 10B:
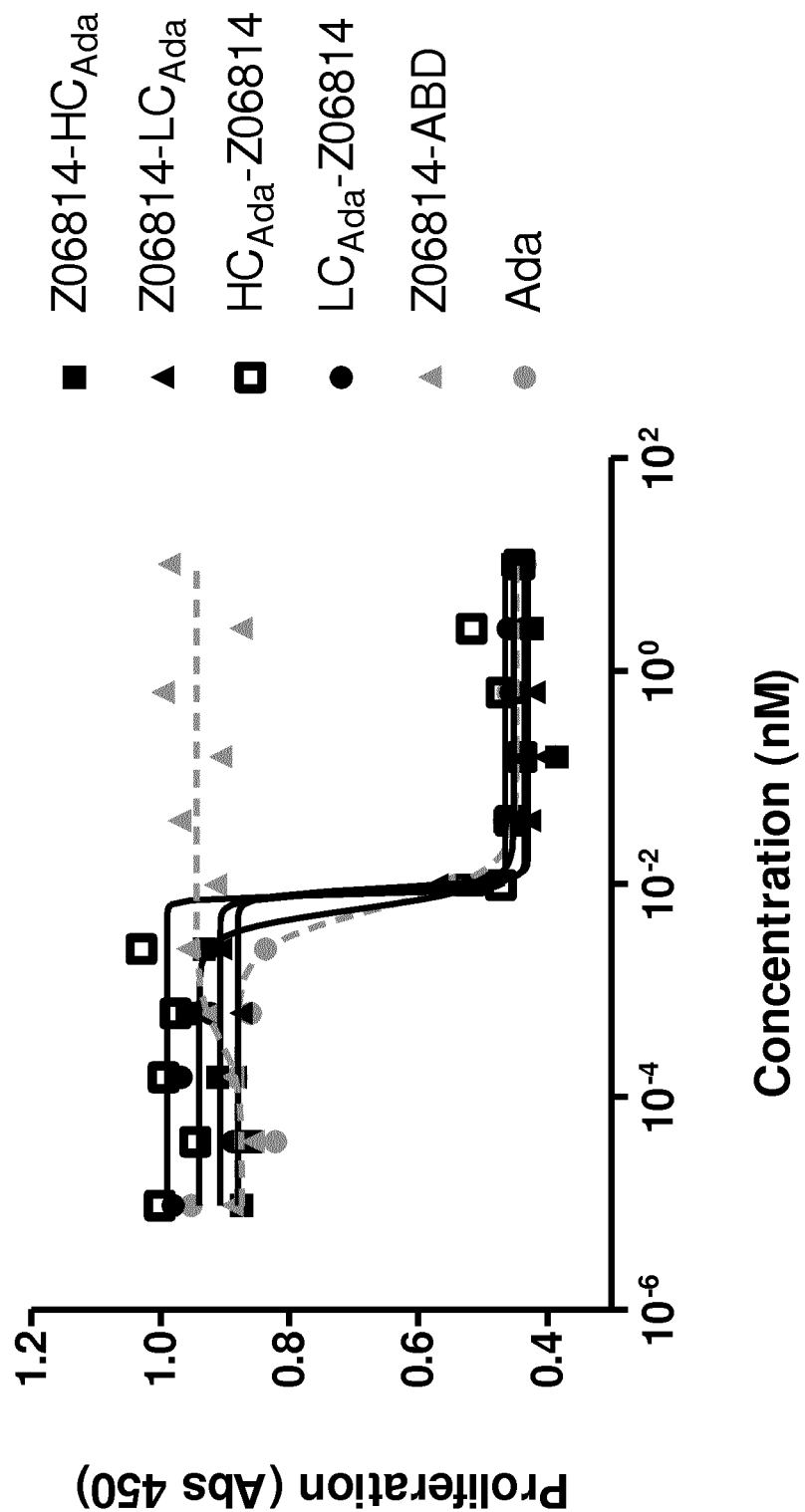

In the experiment where TNF was used to stimulate the cells, all four Ada-based complexes, as well as Ada itself, showed effective blocking of the growth-stimulating TNF signal, all with IC50 values around 10 pM (FIG. 10B). As expected, Z06814-ABD, targeting IL-6 but not TNF, did not show any effect in this assay.

Figure 10C:
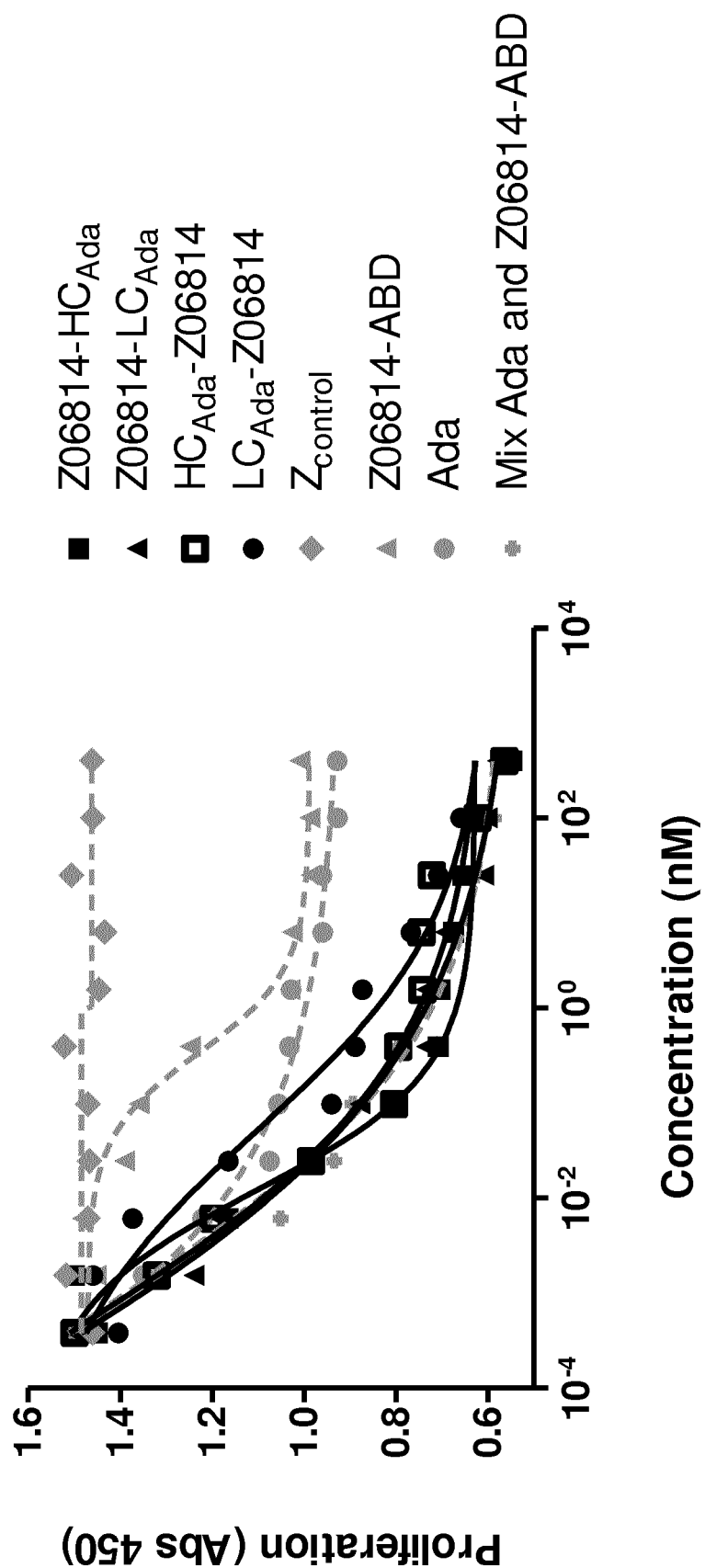

In a second set of experiments, TF-1 cells were simultaneously stimulated with both IL-6 and TNF. The blocking effect of each of the four different complexes was investigated and compared to Ada, Z06814-ABD and a mixture of 1:2 (i.e. equimolar concentrations with respect to number of binding moieties) of Ada and Z06814-ABD. The result showed that all four complexes inhibited TF1 cell proliferation better than either Ada or Z06814-ABD alone (FIG. 10C). When added individually, both Ada and Z06814-ABD showed growth inhibiting effects reaching 50% viability values at the highest concentrations, suggesting that approximately equal cell growth stimulating effects were coming from IL-6 and TNF. When a mixture of 1:2 of Ada and Z06814-ABD was added, complete blocking of cell growth could be observed, suggesting a co-operative blocking effect. The same effect was observed for the Z06814-HC$_{Ada}$ complex, indicating that both its components were functional and that they could independently inhibit TF-1 cell proliferation. No effect was seen with the negative control Z variant, $His_6$-Z04726, binding an irrelevant target (FIG. 10C).

Example 12

Analysis of Biological Activity In Vivo

A Serum Amyloid A (SAA) mouse model was used to study the inflammation blocking effect of Z06814-$HC_{Ada}$ in vivo. The acute phase protein SAA is secreted from liver cells and can be induced by the pro-inflammatory cytokines IL-1, IL-6 and TNF. Due to high sequence homology between the human and mouse cytokines, the human variants are able to act on their corresponding mouse receptors and induce a murine SAA response. However, the human TNF protein can only interact with murine TNF Receptor II (TNFRII), and not with not murine TNF Receptor I (TNFRI).

Materials and Methods

Seven groups of Balb/c mice (n=6) were injected intraperitoneally (i.p.) with 70, 7, 0.7 or 0 (vehicle) mg/kg of Z06814-$HC_{Ada}$ or of Ada. The injections were performed 9 h prior to i.p. administration with a mixture of rhIL-6 and rhTNF, each dosed at 2.5 µg/kg. After 16 h, blood was taken by orbital puncture and serum was collected. Collected serum was assessed for the content of murine SAA by ELISA (Tridelta, cat. no. KMA0021) according to the manufacturer's instructions. In brief, diluted serum samples were added together with anti-SAA-HRP to plates pre-coated with SAA. The plates were incubated for 1 h and then washed four times. TMB substrate was added and the reaction was stopped with stop solution after 20 min. The absorbance was measured at 450 nm using a microplate reader (VICTOR$^3$, Perkin Elmer).

Results

Figure 11:
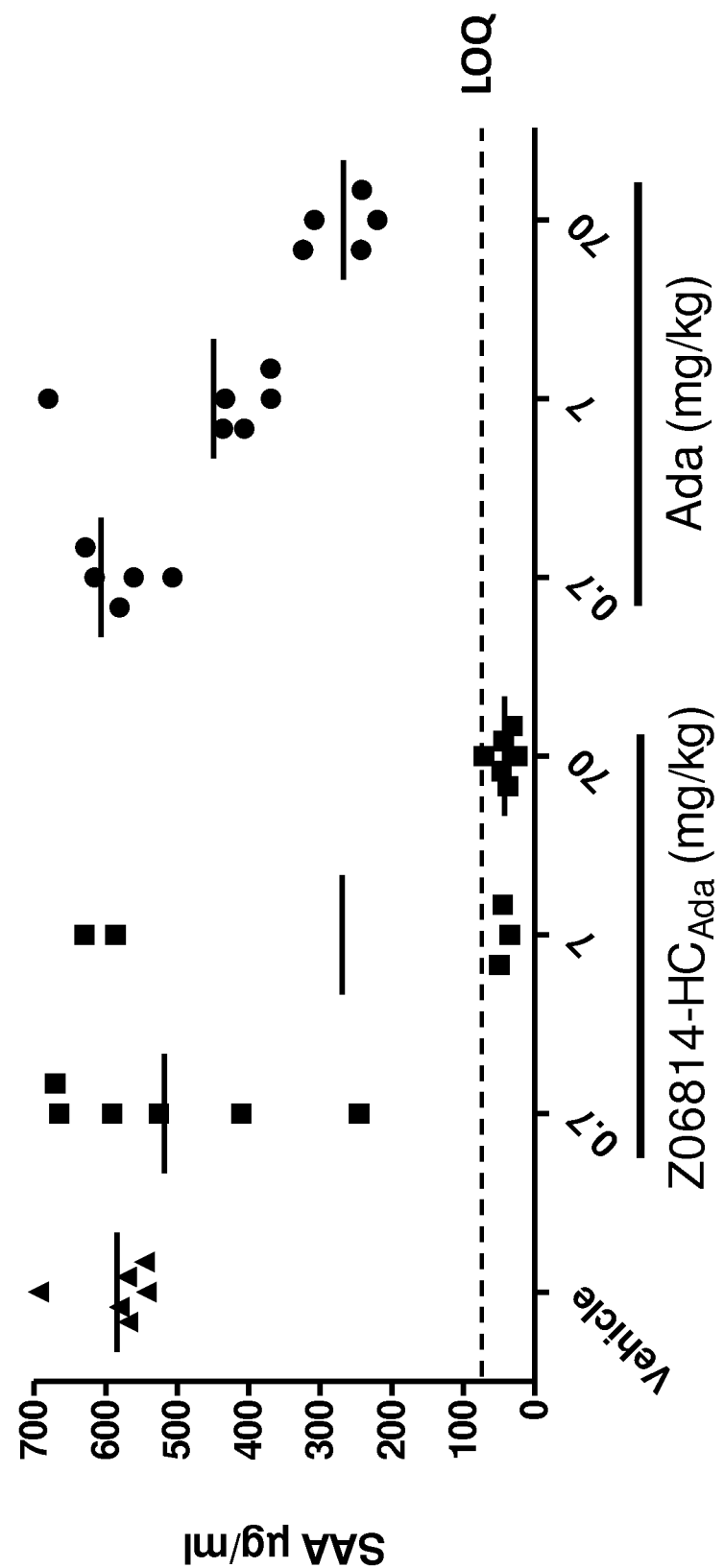
FIG. 11 shows the in vivo efficacy of Z06814-HC$_{Ada}$ (squares) in comparison to Ada (filled circles) in an anti-arthritic mouse model assaying IL-6 triggered serum amyloid-A (SAA) protein release as described in Example 12. Z06814-HC$_{Ada}$ and Ada were injected at doses of 0.7, 7 and 70 mg/kg.

The anti-arthritic efficacy of Z06814-$HC_{Ada}$ was assessed in vivo using a mouse model for IL-6 triggered serum amyloid-A (SAA) protein release. The results show that while a high dose (70 mg/kg) of the TNF blocking antibody Ada alone resulted in only a 50% decrease in observed serum SAA levels, the same dose of Z06814-$HC_{Ada}$ reduced the serum SAA levels to concentrations lower than the limit of quantitation (LOQ) of the test kit used (FIG. 11). This suggests that the combination of the IL-6 signaling blocking polypeptide Z06814 and the TNF blocking Ada antibody in one molecule resulted in a complex capable of dual action and thus of giving therapeutic relief to both the IL-6 and the TNF challenges.

Example 13

Production and Binding Activity of Matured Complexes Targeting IL-6 and TNF

Materials and Methods

Production of Complex Targeting IL-6 and TNF:

Three different complexes targeting IL-6 and TNF were constructed. An antibody denoted "Ada2", having the same CDR sequences and specificity as the commercially available monoclonal antibody adalimumab, was constructed using the heavy chain (HC) and light chain (LC) sequences $HC2_{Ada}$ (SEQ ID NO:1559) and $LC_{Ada}$ (SEQ ID NO:1558). The IL-6 targeting Z variant Z14976 (SEQ ID NO:1) moiety, but starting with the amino acid residues AE instead of VD, was genetically fused via a flexible 5 residue (GGGGS; SEQ ID NO:1591) or 15 residue (GGGGS)$_3$ (SEQ ID NO:1595) linker to the N-termini of $LC_{Ada}$, resulting in complexes denoted Z14976-(GGGGS; SEQ ID NO:1591)-$LC_{Ada}$ and Z14976-(GGGGS)$_3$(SEQ ID NO:1595)-$LC_{Ada}$, respectively, or via a flexible 5 residue (GGGGS; SEQ ID NO:1591) linker to the C-termini of $LC_{Ada}$, resulting in the complex denoted $LC_{Ada}$-(GGGGS; SEQ ID NO:1591)-Z14976. The heavy chain and Z variant-fused light chain constructs were cloned into pcDNA3.1 (Invitrogen) or pOptiVEC (Invitrogen), respectively. The IL-6 and TNF targeting complexes were produced using the CHO-S system (Invitrogen) and purified using Protein A chromatography (GE Healthcare, cat. no. 17-1279-01). The purity of the complexes was analyzed by SDS-PAGE under both non-reduced (6% acrylamide gel) and reduced conditions (12% acrylamide gel).

ELISA Binding Activity:

The binding of TNF and IL-6 targeting complexes was analyzed in an ELISA assay. Half-area 96-well ELISA plates were directly coated at 4° C. overnight with 0.5 µg/ml of TNF or IL-6 in PBS buffer and the wells were blocked with 100 µl of 3% skim milk/PBS (137 mM NaCl, 2.7 mM KCl, 10 mM $Na_2HPO_4$, 1.8 mM $KH_2PO_4$) for 1 h at RT. Next, 30 µl of serially diluted complexes and control antibodies from a starting concentration of 1 µg/ml in 3% skim milk/PBS were added to each well. The plates were incubated for 2 h at RT followed by washing four times with PBST 0.05%. HRP conjugated anti-human IgG Fc secondary antibody (Pierce, cat. no. 31423) was diluted 1:5000 in 3% skim milk/PBS and added to the wells followed by 1 h incubation. After washing as described above, 30 µl ImmunoPure TMB substrate (Pierce, cat. no. 34014) was added to the wells and the plates were treated according to the manufacturer's recommendations. Adalimumab (Abbvie, LOT4435XH04) was used as a positive control for the TNF binding activity and as a negative control for the IL-6 binding activity. Furthermore, an irrelevant IgG (Jackson Immunoresearch, cat. no. Jac-009-000-003) was included as a negative control in both assays.

Results

Figure 12:
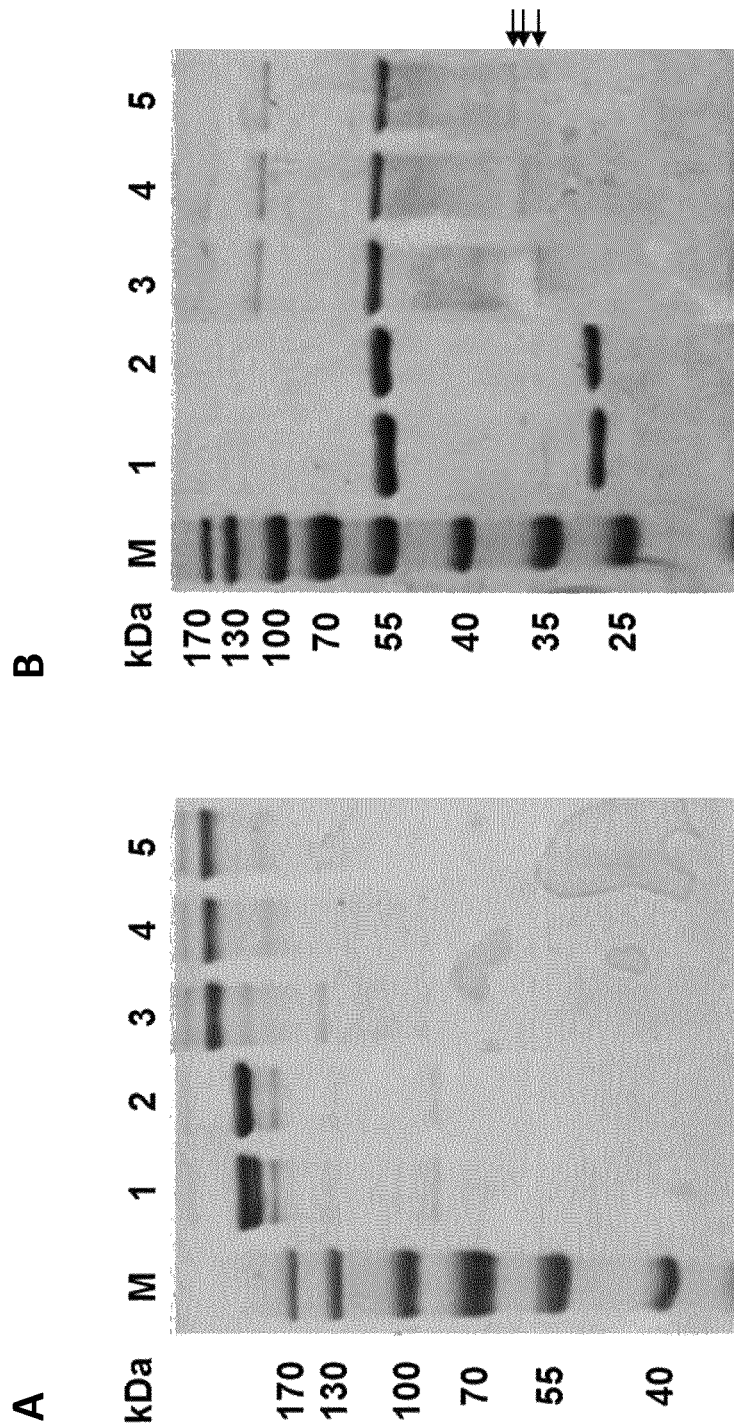
FIG. 12 shows the SDS-PAGE analysis of purified complexes described in Example 13. A) Non-reduced conditions. B) Reduced conditions. Lane M: Molecular weight standard; lane 1: trastuzumab (control IgG), lane 2: adalimumab (control IgG); lane 3: LC$_{Ada}$-GGGGS(SEQ ID NO:1591)-Z14976; lane 4: Z14976-(GGGGS(SEQ ID NO:1591))-LC$_{Ada}$; lane 5: Z14976-(GGGGS)$_3$(SEQ ID NO:1595)-LC$_{Ada}$. The arrows in B) indicate the light chains fused to Z14976.

Production of Complex Targeting IL-6 and TNF:

SDS page analyses of purified complexes under non-reduced and reduced conditions are shown in FIGS. 12A and B, respectively. Analysis performed under reduced conditions (FIG. 12B) confirmed the expected size of the individual subunits.

ELISA Binding Activity:

The result of the ELISA binding analyses confirmed retained binding to TNF for all tested complexes, i.e. Z14976-(GGGGS; SEQ ID NO:1591)-$LC_{Ada}$, Z14976-(GGGGS)$_3$(SEQ ID NO:1595)-$LC_{Ada}$ and $LC_{Ada}$-(GGGGS; SEQ ID NO:1591)-Z14976 (FIG. 13A). IL-6 binding was retained for the complexes Z14976-(GGGGS; SEQ ID NO:1591)-$LC_{Ada}$ and Z14976-(GGGGS)$_3$(SEQ ID NO:1595)-$LC_{Ada}$ but not for $LC_{Ada}$-(GGGGS; SEQ ID NO:1591)-Z14976 (FIG. 13B). The approximate calculated EC50 values for each respective interaction are shown in Table 18.

TABLE 18

Approximate EC50 values for interaction with TNF and IL-6

| Polypeptide | EC50 (M) | |
|---|---|---|
| | TNF binding | IL-6 binding |
| Z14976-(GGGGS SEQ ID NO:1591)-LC$_{Ada}$; | $9.4 \times 10^{-11}$ | $5.6 \times 10^{-10}$ |
| Z14976-(GGGGS)$_3$(SEQ ID NO:1595)-LC$_{Ada}$; | $1.2 \times 10^{-10}$ | $9.5 \times 10^{-10}$ |
| LC$_{Ada}$-(GGGGS SEQ ID NO:1591)-Z14976; | $1.7 \times 10^{-10}$ | — |
| Adalimumab | $7.7 \times 10^{-11}$ | N/A |

ITEMIZED LIST OF EMBODIMENTS

1. Complex comprising at least one IL-6 binding polypeptide and at least one antibody or an antigen binding fragment thereof, wherein said IL-6 binding polypeptide comprises an IL-6 binding motif BM, which motif consists of an amino acid sequence selected from:
i) EEX$_3$X$_4$AWX$_7$EIHX$_{11}$LPNLX16X$_{17}$X$_{18}$QX$_{20}$X$_{21}$ AFIX$_{25}$X$_{26}$LX$_{28}$X$_{29}$(SEQ ID NO:1565)
wherein, independently from each other,
X$_3$ is selected from A, F, H, K, Q, R, S, W and Y;
X$_4$ is selected from A, D, E, F, H, I, K, L, M, N, Q, R, S, T, V and Y;
X$_7$ is selected from F, H, I, K, L, M, N, R, S, T, V, W and Y;
X$_{11}$ is selected from A, I, K, L, M, N, R, S, T and V;
X$_{16}$ is selected from N and T;
X$_{17}$ is selected from A, I, T and V;
X$_{18}$ is selected from D, E, G, H, K, N, Q, R, S and T;
X$_{20}$ is selected from I, L, M, R, T and V;
X$_{21}$ is selected from A, S, T and V;
X$_{25}$ is selected from I, M, Q, S, T, V and W;
X$_{26}$ is selected from K and S,
X$_{28}$ is selected from F, L, M and Y; and
X$_{29}$ is selected from D and R;
and
ii) an amino acid sequence which has at least 93% identity to the sequence defined in i).

2. Complex according to item 1, wherein in sequence i):
X$_3$ is selected from A, H, K, Q, R and Y;
X$_4$ is selected from A, D, E, F, H, I, K, L, M, N, Q, R, S, T, V and Y;
X$_7$ is selected from F, H, I, K, L, M, N, R, T, V, W and Y;
X$_{11}$ is selected from A, I, K, L, N, S, T and V;
X$_{16}$ is T;
X$_{17}$ is selected from A, I, T and V;
X$_{18}$ is selected from D, E, H, K, N, Q, R, S and T;
X$_{20}$ is selected from I, L, M, R and V;
X$_{21}$ is selected from A, S and V;
X$_{25}$ is selected from I, Q, S, T, V and W;
X$_{26}$ is K;
X$_{28}$ is selected from F, L, M and Y; and
X$_{29}$ is D.

3. Complex according to item 1 or 2, wherein sequence i) fulfills at least six of the eleven conditions I-XI:
I. X$_3$ is selected from K and R;
II. X$_{11}$ is selected from A and L;
III. X$_{16}$ is T;
IV. X$_{17}$ is selected from I and V;
V. X$_{18}$ is selected from D and E;
VI. X$_{20}$ is M;
VII. X$_{21}$ is A;
VIII. X$_{25}$ is selected from S and T;
IX. X$_{26}$ is K;
X. X$_{28}$ is F; and
XI. X$_{29}$ is D.

4. Complex according to item 3, wherein sequence i) fulfills at least seven of the eleven conditions I-XI.

5. Complex according to item 4, wherein sequence i) fulfills at least eight of the eleven conditions I-XI.

6. Complex according to item 5, wherein sequence i) fulfills at least nine of the eleven conditions I-XI.

7. Complex according to item 6, wherein sequence i) fulfills at least ten of the eleven conditions I-XI.

8. Complex according to item 7, wherein sequence i) fulfills all of the eleven conditions I-XI.

9. Complex according to any preceding item, wherein X$_{17}$X$_{20}$X$_{21}$ is selected from VMA and IMA.

10. Complex according to any one of items 1-8, wherein X$_{20}$X$_{21}$X$_{28}$ is MAF.

11. Complex according to any one of items 1-8, wherein X$_{17}$X$_{20}$X$_{28}$ is selected from VMF and IMF.

12. Complex according to any one of items 1-8, wherein X$_{17}$X$_{21}$X$_{28}$ is selected from VAF and IAF.

13. Complex according to any preceding item, wherein sequence i) corresponds to the sequence from position 8 to position 36 in a sequence selected from the group consisting of SEQ ID NO:1-1551.

14. Complex according to item 13, wherein sequence i) corresponds to the sequence from position 8 to position 36 in a sequence selected from the group consisting of SEQ ID NO:1-1502.

15. Complex according to item 14, wherein sequence i) corresponds to the sequence from position 8 to position 36 in a sequence selected from the group consisting of SEQ ID NO:7, SEQ ID NO:15-89 and SEQ ID NO:151-871.

16. Complex according to item 14, wherein sequence i) corresponds to the sequence from position 8 to position 36 in a sequence selected from the group consisting of SEQ ID NO:1-6, SEQ ID NO:8-14, SEQ ID NO:90-150 and SEQ ID NO:872-1502.

17. Complex according to item 13, wherein sequence i) corresponds to the sequence from position 8 to position 36 in a sequence selected from the group consisting of SEQ ID NO:1-152 and SEQ ID NO:1503-1515.

18. Complex according to item 17, wherein sequence i) corresponds to the sequence from position 8 to position 36 in a sequence selected from the group consisting of SEQ ID NO:1-150 and SEQ ID NO:1503-1515.

19. Complex according to item 17, wherein sequence i) corresponds to the sequence from position 8 to position 36 in a sequence selected from the group consisting of SEQ ID NO:1-152.

20. Complex according to item 18 or 19, wherein sequence i) corresponds to the sequence from position 8 to position 36 in a sequence selected from the group consisting of SEQ ID NO:1-150.

21. Complex according to item 19, wherein sequence i) corresponds to the sequence from position 8 to position 36 in a sequence selected from the group consisting of SEQ ID NO:7, SEQ ID NO:15-89 and SEQ ID NO:151-152.

22. Complex according to item 20, wherein sequence i) corresponds to the sequence from position 8 to position 36 in a sequence selected from the group consisting of SEQ ID NO:1-6, SEQ ID NO:8-14 and SEQ ID NO:90-150.

23. Complex according to item 18, wherein sequence i) corresponds to the sequence from position 8 to position 36 in a sequence selected from the group consisting of SEQ ID NO:1-14 and SEQ ID NO:1503-1515.

24. Complex according to item 23, wherein sequence i) corresponds to the sequence from position 8 to position 36 in a sequence selected from the group consisting of SEQ ID NO:1-14 and SEQ ID NO:1512.

25. Complex according to item 24, wherein sequence i) corresponds to the sequence from position 8 to position 36 in a sequence selected from the group consisting of SEQ ID NO:1-14.

26. Complex according to any one of items 16, 22 and 25, wherein sequence i) corresponds to the sequence from position 8 to position 36 in a sequence selected from the group consisting of SEQ ID NO:1-5.

27. Complex according to item 24, wherein sequence i) wherein sequence i) corresponds to the sequence from position 8 to position 36 in SEQ ID NO:1512.

28. Complex according to any preceding item, wherein said IL-6 binding motif forms part of a three-helix bundle protein domain.

29. Complex according to item 28, wherein said IL-6 binding motif essentially forms part of two helices with an interconnecting loop, within said three-helix bundle protein domain.

30. Complex according to item 29, wherein said three-helix bundle protein domain is selected from bacterial receptor domains.

31. Complex according to item 30, wherein said three-helix bundle protein domain is selected from domains of protein A from *Staphylococcus aureus* or derivatives thereof.

32. Complex according to any preceding item, wherein said IL-6 binding polypeptide comprises a binding module BMod, the amino acid sequence of which is selected from:

iii)
K-[BM]-DPSQSX$_a$X$_b$LLX$_c$EAKKLX$_d$X$_e$X$_f$Q;   (SEQ ID NO: 1566)

wherein
 [BM] is an IL-6 binding motif as defined in any one of items 1-27 provided that $X_{29}$ is ID,
 $X_a$ is selected from A and S,
 $X_b$ is selected from N and E;
 $X_c$ is selected from A, S and C;
 $X_d$ is selected from E, N and S,
 $X_e$ is selected from D, E and S,
 $X_f$ is selected from A and S, and
iv) an amino acid sequence which has at least 91% identity to a sequence defined by iii).

33. Complex according to any one of items 1-31, wherein said IL-6 binding polypeptide comprises a binding module BMod, the amino acid sequence of which is selected from:

v)
K-[BM]-DPSQSX$_a$X$_b$LLX$_c$EAKKLX$_d$X$_e$X$_f$Q,   (SEQ ID NO: 1567)

wherein
 [BM] is an IL-6 binding motif as defined in any one of items 1-27 provided that $X_{29}$ is R;
 $X_a$ is selected from A and S,
 $X_b$ is selected from N and E;
 $X_c$ is selected from A, S and C;
 $X_d$ is selected from E, N and S,
 $X_e$ is selected from D, E and S,
 $X_f$ is selected from A and S, and
vi) an amino acid sequence which has at least 91% identity to a sequence defined by v).

34. Complex according to any one of items 1-32, wherein sequence iii) corresponds to the sequence from position 7 to position 55 in a sequence selected from the group consisting of SEQ ID NO:1-1551.

35. Complex according to item 34, wherein sequence iii) corresponds to the sequence from position 7 to position 55 in a sequence selected from the group consisting of SEQ ID NO:1-1502.

36. Complex according to item 35, wherein sequence iii) corresponds to the sequence from position 7 to position 55 in a sequence selected from the group consisting of SEQ ID NO:7, SEQ ID NO:15-89 and SEQ ID NO:151-871.

37. Complex according to item 35, wherein sequence iii) corresponds to the sequence from position 7 to position 55 in a sequence selected from the group consisting of SEQ ID NO:1-6, SEQ ID NO:8-14, SEQ ID NO:90-150 and SEQ ID NO:872-1502.

38. Complex according to item 34, wherein sequence iii) corresponds to the sequence from position 7 to position 55 in a sequence selected from the group consisting of SEQ ID NO:1-152 and SEQ ID NO:1503-1515.

39. Complex according to item 38, wherein sequence iii) corresponds to the sequence from position 7 to position 55 in a sequence selected from the group consisting of SEQ ID NO:1-150 and SEQ ID NO:1503-1515.

40. Complex according to item 35 or 38, wherein sequence iii) corresponds to the sequence from position 7 to position 55 in a sequence selected from the group consisting of SEQ ID NO:1-152.

41. Complex according to item 39 or 40, wherein sequence iii) corresponds to the sequence from position 7 to position 55 in a sequence selected from the group consisting of SEQ ID NO:1-150.

42. Complex according to item 40, wherein sequence iii) corresponds to the sequence from position 7 to position 55 in a sequence selected from the group consisting of SEQ ID NO:7, SEQ ID NO:15-89 and SEQ ID NO:151-152.

43. Complex according to item 41, wherein sequence iii) corresponds to the sequence from position 7 to position 55 in a sequence selected from the group consisting of SEQ ID NO:1-6, SEQ ID NO:8-14 and SEQ ID NO:90-150.

44. Complex according to item 39, wherein sequence iii) corresponds to the sequence from position 7 to position 55 in a sequence selected from the group consisting of SEQ ID NO:1-14 and SEQ ID NO:1503-1515.

45. Complex according to item 44, wherein sequence iii) corresponds to the sequence from position 7 to position 55 in a sequence selected from the group consisting of SEQ ID NO:1-14 and SEQ ID NO:1512.

46. Complex according to item 45, wherein sequence iii) corresponds to the sequence from position 7 to position 55 in a sequence selected from the group consisting of SEQ ID NO:1-14.

47. Complex according to any one of items 36, 42 and 46, wherein sequence iii) corresponds to the sequence from position 7 to position 55 in a sequence selected from the group consisting of SEQ ID NO:1-5.

48. Complex according to item 45, wherein sequence iii) corresponds to the sequence from position 7 to position 55 in SEQ ID NO:1512.

49. Complex according to any preceding item, wherein said IL-6 binding polypeptide comprises an amino acid sequence selected from:
vii) YA-[BMod]-AP (SEQ ID NO:1568),
 wherein [BMod] is an IL-6 binding module as defined in any one of items 32-48; and viii) an amino acid sequence which has at least 90% identity to a sequence defined by vii).

50. Complex according to any one of items 1-48, wherein said IL-6 binding polypeptide comprises an amino acid sequence selected from:

ix) FN-[BMod]-AP (SEQ ID NO:1569),
wherein [BMod] is an IL-6 binding module as defined in any one of items 32-48; and x) an amino acid sequence which has at least 90% identity to a sequence defined by ix).

51. Complex according to any preceding item, which comprises an amino acid sequence selected from:

```
ADNNFNK-[BM]-DPSQSANLLSEAKKLNESQAPK;
(SEQ ID NO: 1570)

ADNKFNK-[BM]-DPSQSANLLAEAKKLNDAQAPK;
(SEQ ID NO: 1571)

ADNKFNK-[BM]-DPSVSKEILAEAKKLNDAQAPK;
(SEQ ID NO: 1572)

ADAQQNNFNK-[BM]-DPSQSTNVLGEAKKLNESQAPK;(SEQ ID NO:
1573)

AQHDE-[BM]-DPSQSANVLGEAQKLNDSQAPK; (SEQ ID NO: 1574)

VDNKFNK-[BM]-DPSQSANLLAEAKKLNDAQAPK;
(SEQ ID NO: 1575)

AEAKYAK-[BM]-DPSESSELLSEAKKLNKSQAPK;
(SEQ ID NO: 1576)

VDAKYAK-[BM]-DPSQSSELLAEAKKLNDAQAPK;
(SEQ ID NO: 1577)

VDAKYAK-[BM]-DPSQSSELLAEAKKLNDSQAPK;
(SEQ ID NO: 1578)

AEAKYAK-[BM]-DPSQSSELLSEAKKLNDSQAPK;
(SEQ ID NO: 1579)

AEAKYAK-[BM]-DPSQSSELLSEAKKLSESQAPK;
(SEQ ID NO: 1580)

AEAKYAK-[BM]-QPEQSSELLSEAKKLSESQAPK;
(SEQ ID NO: 1581)

AEAKYAK-[BM]-DPSQSSELLSEAKKLESSQAPK;
(SEQ ID NO: 1582)

AEAKYAK-[BM]-QPEQSSELLSEAKKLESSQAPK;
(SEQ ID NO: 1583)

VDAKYAK-[BM]-DPSQSSELLSEAKKLNDSQAPK;
(SEQ ID NO: 1584)

VDAKYAK-[BM]-DPSQSSELLSEAKKLSESQAPK;
(SEQ ID NO: 1585)

VDAKYAK-[BM]-QPEQSSELLSEAKKLSESQAPK;
(SEQ ID NO: 1586)

VDAKYAK-[BM]-DPSQSSELLSEAKKLESSQAPK;
(SEQ ID NO: 1587)

VDAKYAK-[BM]-QPEQSSELLSEAKKLESSQAPK;
(SEQ ID NO: 1588)

VDAKYAK-[BM]-DPSQSSELLAEAKKLNKAQAPK;
(SEQ ID NO: 1589)
and

AEAKYAK-[BM]-DPSQSSELLAEAKKLNKAQAPK;
(SEQ ID NO: 1590)
``` wherein [BM] is an IL-6 binding motif as defined in any one of items 1-27.

52. Complex according to any one of items 1-49, which comprises an amino acid sequence selected from:

```
xi)
VDAKYAK-[BM]-DPSQSSELLSEAKKLNDSQAPK;
(SEQ ID NO: 1584)
``` wherein [BM] is an IL-6 binding motif as defined in any one of items 1-27; and xii) an amino acid sequence which has at least 89% identity to the sequence defined in xi).

53. Complex according to any one of items 1-49, which comprises an amino acid sequence selected from:

```
xiii)
AEAKYAK-[BM]-DPSQSSELLSEAKKLNDSQAPK;
(SEQ ID NO: 1579)
``` wherein [BM] is an IL-6 binding motif as defined in any one of items 1-27; and xiv) an amino acid sequence which has at least 89% identity to the sequence defined in xiii).

54. Complex according to item 52, wherein sequence xi) is selected from the group consisting of SEQ ID NO:1-1551.

55. Complex according to item 54, wherein sequence xi) is selected from the group consisting of SEQ ID NO:1-1502.

56. Complex according to item 55, wherein sequence xi) is selected from the group consisting of SEQ ID NO:7, SEQ ID NO:15-89 and SEQ ID NO:151-871.

57. Complex according to item 55, wherein sequence xi) is selected from the group consisting of SEQ ID NO:1-6, SEQ ID NO:8-14, SEQ ID NO:90-150 and SEQ ID NO:872-1502.

58. Complex according to item 54, wherein sequence xi) is selected from the group consisting of SEQ ID NO:1-152 and SEQ ID NO:1503-1515.

59. Complex according to item 58, wherein sequence xi) is selected from the group consisting of SEQ ID NO:1-150 and SEQ ID NO:1503-1515.

60. Complex according to item 55 or 58, wherein sequence xi) is selected from the group consisting of SEQ ID NO:1-152.

61. Complex according to item 59 or 60, wherein sequence xi) is selected from the group consisting of SEQ ID NO:1-150.

62. Complex according to item 60, wherein sequence xi) is selected from the group consisting of SEQ ID NO:7, SEQ ID NO:15-89 and SEQ ID NO:151-152.

63. Complex according to item 61, wherein sequence xi) is selected from the group consisting of SEQ ID NO:1-6, SEQ ID NO:8-14 and SEQ ID NO:90-150.

64. Complex according to item 59, wherein sequence xi) is selected from the group consisting of SEQ ID NO:1-14 and SEQ ID NO:1503-1515.

65. Complex according to item 64, wherein sequence xi) is selected from the group consisting of SEQ ID NO:1-14 and SEQ ID NO:1512.

66. Complex according to item 65, wherein sequence xi) is selected from the group consisting of SEQ ID NO:1-14.

67. Complex according to any one of items 57, 63 and 66, wherein sequence xi) is selected from the group consisting of SEQ ID NO:1-5.

68. Complex according to item 65, wherein sequence xi) is SEQ ID NO:1512.

69. Complex according to any preceding item, which comprises additional amino acids at at least one C-terminal and/or N-terminal end.

70. Complex according to item 69, wherein said additional amino acid(s) improve(s) production, purification, stabilization in vivo or in vitro, coupling or detection of the complex.

71. Complex according to any preceding item, comprising said IL-6 binding polypeptide in multimeric form, such as comprising at least two IL-6 binding polypeptide monomer units, whose amino acid sequences may be the same or different.

72. Complex according to item 71, wherein said IL-6 binding polypeptide monomer units are covalently coupled together.

73. Complex according to item 72, wherein the IL-6 binding polypeptide monomer units are in the form of a fusion protein.

74. Complex according to item 73, wherein the IL-6 binding polypeptide monomer units are in dimeric form.

75. Complex according to any preceding item, wherein said at least one antibody or antigen binding fragment thereof is selected from the group consisting of full-length antibodies, Fab fragments, Fab' fragments, F(ab')$_2$ fragments, Fc fragments, Fv fragments, single chain Fv fragments, (scFv)$_2$ and domain antibodies.

76. Complex according to item 75, wherein said at least one antibody or antigen binding fragment thereof is selected from the group consisting of full-length antibodies, Fab fragments and scFv fragments.

77. Complex according to item 76, wherein said at least one antibody or antigen binding fragment thereof is a full-length antibody.

78. Complex according to any one of items 75-77, wherein said antibody or antigen binding fragment thereof is a monoclonal antibody or an antigen binding fragment thereof.

79. Complex according to any one of items 75-78, wherein said antibody or antigen binding fragment thereof is selected from the group consisting of human antibodies, humanized antibodies and chimeric antibodies, and antigen-binding fragments thereof.

80. Complex according to item 79, wherein said antibody or antigen binding fragment thereof is a human or humanized antibody, or an antigen binding fragment thereof.

81. Complex according to any preceding item, wherein said antibody or antigen binding fragment thereof has affinity for an antigen, for example an antigen associated with a disease or disorder of the immune system, or an antigen associated with cancer.

82. Complex according to item 81, wherein said antigen is selected from the group consisting of angiogenin 2 (Ang-2), vascular endothelial growth factor, tumor necrosis factor, TNFSF11, TNFSF13, TNFSF13B, TNFSF14, TNFSF15, insulin-like growth factor, interleukin 1α, interleukin 16, interleukin 10, interleukin 17A, interleukin 12, interleukin 23, interleukin 33, granulocyte macrophage colony-stimulating factor, granulocyte colony-stimulating factor, high-mobility group protein B1, lipopolysaccharide, toll-like receptor 4, nerve growth factor, chemokine C-C motif ligand 19, chemokine C-C motif ligand 21, chemokine C-X-C motif ligand 4 and interferon alpha.

83. Complex according to item 82, wherein said antigen is selected from the group consisting of interleukin 1β, tumor necrosis factor, granulocyte macrophage colony-stimulating factor, granulocyte colony-stimulating factor, interleukin 12, interleukin 17, interleukin 23, high-mobility group protein B1, lipopolysaccharide and toll-like receptor 4.

84. Complex according to any one of items 82-83, wherein said antigen is a cytokine, for example selected from the group consisting of interleukin 1β, tumor necrosis factor, granulocyte macrophage colony-stimulating factor, granulocyte colony-stimulating factor, interleukin 12, interleukin 17 and interleukin 23.

85. Complex according to item 84, wherein said antigen is tumor necrosis factor.

86. Complex according to item 85, wherein said antibody or antigen binding fragment thereof is selected from the group consisting of adalimumab, infliximab, golimumab and certolizumab pegol and antigen binding fragments thereof, for example a full-length antibody selected from the group consisting of adalimumab, infliximab, golimumab and certolizumab pegol.

87. Complex according to item 86, wherein said antibody or antigen binding fragment thereof is adalimumab or an antigen binding fragment thereof, for example full-length adalimumab.

88. Complex according to any preceding item, which is capable of blocking IL-6 dependent signaling via the cis-signaling pathway and/or the trans-signaling pathway.

89. Complex according to item 88, wherein the half maximal inhibitory concentration of blocking IL-6 signaling is at most $1\times10^{-6}$ M, such as at most $1\times10^{-7}$ M, such as at most $1\times10^{-8}$ M, such as at most $1\times10^{-9}$ M, such as at most $1\times10^{-10}$ M.

90. Complex according to any one of items 88-89, which is capable of blocking the interaction of IL-6/IL-6Rα with gp130.

91. Complex according to any preceding item, which is capable of binding to IL-6 such that the EC50 value of the interaction is at most $1\times10^{-7}$ M, such as at most $1\times10^{-8}$ M, such as at most $1\times10^{-9}$ M, such as at most $1\times10^{-10}$ M.

92. Complex according to any preceding item, which is capable of binding to IL-6 such that the $K_D$ value of the interaction is at most $1\times10^{-8}$ M, such as at most $1\times10^{-9}$ M, such as at most $1\times10^{-10}$ M, such as at most $1\times10^{-11}$ M.

93. Complex according to any preceding item, which is capable of blocking TNF dependent signaling.

94. Complex according to item 93, wherein the half maximal inhibitory concentration (1050) of blocking TNF dependent signaling is at most $1\times10^{-7}$ M, such as at most $1\times10^{-8}$ M, such as at most $1\times10^{-9}$ M, such as at most $1\times10^{-10}$ M, such as at most $1\times10^{-11}$ M.

95. Complex according to any preceding item, which is capable of binding to TNF such that the $K_D$ value of the interaction is at most $1\times10^{-7}$ M, such as at most $1\times10^{-8}$ M, such as at most $1\times10^{-9}$ M, such as at most $1\times10^{-10}$ M, such as at most $1\times10^{-11}$ M, such as at most $1\times10^{-12}$ M.

96. Complex according to any preceding item, which is a fusion protein or a conjugate.

97. Complex according to any preceding item, wherein said IL-6 binding polypeptide is attached to the N-terminus or C-terminus of the heavy chain of said antibody or antigen binding fragment thereof.

98. Complex according to any one of items 1-96, wherein said IL-6 binding polypeptide is attached to the N-terminus or C-terminus of the light chain of said antibody or antigen binding fragment thereof.

99. Complex according to item 97, wherein said IL-6 binding polypeptide is attached to the N-terminus and/or C-terminus of the light chain and heavy chain of said antibody or antigen binding fragment thereof.

100. Complex according to any one of items 96-99, which is a fusion protein.

101. Complex according to claim 100, further comprising at least one linker, such as selected from the group consisting of flexible amino acid linkers, rigid amino acid linkers and cleavable amino acid linkers.

102. Complex according to claim 101, wherein said linker is arranged between said IL-6 binding polypeptide and said antibody or antigen binding fragment thereof.

103. Complex according to claim 102, wherein said linker is a flexible linker comprising amino acid residues selected from the group consisting of glycine, serine and threonine.

104. Complex according to claim 103, wherein said linker has a general formula selected from $(G_nS_m)_p$ and $(S_mG_n)_p$, wherein, independently,
n=1-7,
m=0-7,
n+m≤8 and
p=1-7.

105. Complex according to claim 104, wherein n=1-5.

106. Complex according to any one of claims 104-105, wherein m=0-5.

107. Complex according to any one of claims 104-106, wherein p=1-5.

108. Complex according to any one of claims 105-107, wherein n=4, m=1 and p=1-4.

109. Complex according to claim 108, wherein said flexible linker is (GGGGS)₃ (SEQ ID NO:1595) or GGGGS (SEQ ID NO:1591).

110. A polynucleotide encoding a polypeptide encoding a fusion protein according to any preceding item.

111. Expression vector comprising a polynucleotide according to item 110.

112. Host cell comprising an expression vector according to item 111.

113. Method of producing a complex according to any one of items 1-109, comprising
culturing a host cell according to item 112 under conditions permissive of expression of said fusion protein from said expression vector, and
isolating said polypeptide.

114. Composition comprising a complex according to any one of items 1-109 and at least one pharmaceutically acceptable excipient or carrier.

115. Composition according to item 114, further comprising at least one additional active agent, for example an agent selected from an immune response modifying agent and an anti-cancer agent.

116. Complex according to any one of items 1-109 or a composition according to any one of items 114-115 for oral, topical, intravenous, intraperitoneal, subcutaneous, pulmonary, transdermal, intramuscular, intranasal, buccal, sublingual or suppository administration.

117. Complex according to any one of items 1-109 or a composition according to any one of items 114-115 for use as a medicament.

118. Complex or composition for use according to item 117, wherein said complex or composition modulates IL-6 function and the function of an additional antigen, for example an antigen associated with a disease or disorder of the immune system in vivo, or an antigen associated with cancer.

119. Complex or composition for use according to item 118, wherein said complex or composition modulates IL-6 function and TNF function in vivo.

120. Complex or composition for use according to any one of items 117-119 in the treatment of an IL-6 related disorder, such as a disorder related to IL-6 and TNF.

121. Complex or composition for use according to item 120, wherein said IL-6 related disorder is selected from the group consisting of autoimmune diseases, inflammatory diseases, cancer and neoplastic diseases, for example an IL-6 related disorder selected from chronic inflammatory diseases and inflammation-induced cancers.

122. Complex or composition for use according to item 121, wherein said disorder is selected from the group consisting of rheumatoid arthritis; juvenile rheumatoid arthritis; juvenile idiopathic arthritis; systemic juvenile idiopathic arthritis; vasculitis; psoriatic arthritis; psoriasis; ankylosing spondylitis; chronic inflammatory bowel disease, for example Crohn's disease and ulcerative colitis; Grave's disease; Behçet's disease; uveitis; giant cell arteritis; multiple sclerosis; systemic sclerosis; systemic lupus erythematosus; polymyositis; polymyalgia rheumatic; asthma; chronic obstructive pulmonary disease; relapsing polychondritis; pancreatitis; peritonitis; nephritis; Kawasaki's disease; Sjögren's syndrome and adult Still's disease.

123. Complex or composition for use according to item 121, wherein said disorder is cancer or neoplastic disease, such as selected from the group consisting of colitis associated cancer, renal cancer, kidney cancer, prostate cancer, malignant lymphoma, multiple myeloma, Castleman's disease, breast cancer and lung cancer.

124. Complex or composition for use according to item 121, wherein said disorder is selected from Alzheimer's disease, HIV, diabetes, sepsis, cachexia, myelodysplastic syndrome (MDS), liver cirrhosis, graft versus host disease, myocardial infarction, endometriosis and osteoporosis.

125. Method of treatment of an IL-6 related disorder, comprising administering to a subject in need thereof an effective amount of a complex according to any one of items 1-109 or a composition according to any one of items 114-115.

126. Method according to item 125, wherein said disorder is a disorder related to IL-6 and TNF.

127. Method according to item 125 or 126, wherein said disorder is selected from autoimmune diseases, inflammatory diseases, cancer and neoplastic diseases, for example an IL-6 related disorder selected from chronic inflammatory diseases and inflammation-induced cancers.

128. Method according to item 127, wherein said disorder is selected from the group consisting of rheumatoid arthritis; juvenile rheumatoid arthritis; juvenile idiopathic arthritis; systemic juvenile idiopathic arthritis; vasculitis; psoriatic arthritis; psoriasis; ankylosing spondylitis; chronic inflammatory bowel disease, for example Crohn's disease and ulcerative colitis; Grave's disease; Behçet's disease; uveitis; giant cell arteritis; multiple sclerosis; systemic sclerosis; systemic lupus erythematosus; polymyositis; polymyalgia rheumatic; asthma; chronic obstructive pulmonary disease; relapsing polychondritis; pancreatitis; peritonitis; nephritis; Kawasaki's disease; Sjögren's syndrome and adult Still's disease.

129. Method according to item 127, wherein said disorder is cancer or neoplastic disease, such as selected from the group consisting of colitis associated cancer, renal cancer, kidney cancer, prostate cancer, malignant lymphoma, multiple myeloma, Castleman's disease, breast cancer and lung cancer.

130. Method according to item 127, wherein said disorder is selected from Alzheimer's disease, HIV, diabetes, sepsis, cachexia, myelodysplastic syndrome (MDS), liver cirrhosis, graft versus host disease, myocardial infarction, endometriosis and osteoporosis.

SEQUENCE LISTING (1601 sequences)

SEQ ID NO: 1 - protein, 58 aa, ARTIFICIAL SEQUENCE
  Engineered IL-6 binding polypeptide
VDAKYAKEERKAWYEIHLLPNLTVEQMAAFITKLFDDPSQSSELLSEAKKLNDSQAPK

SEQ ID NO: 2 - protein, 58 aa, ARTIFICIAL SEQUENCE
  Engineered IL-6 binding polypeptide
VDAKYAKEERDAWWEIHALPNLTVEQMAAFITKLFDDPSQSSELLSEAKKLNDSQAPK

SEQ ID NO: 3 - protein, 58 aa, ARTIFICIAL SEQUENCE
  Engineered IL-6 binding polypeptide
VDAKYAKEERHAWYEIHLLPNLTIDQMAAFISKLFDDPSQSSELLSEAKKLNDSQAPK

SEQ ID NO: 4 - protein, 58 aa, ARTIFICIAL SEQUENCE
  Engineered IL-6 binding polypeptide
VDAKYAKEERKAWIEIHNLPNLTIDQMAAFITKLFDDPSQSSELLSEAKKLNDSQAPK

SEQ ID NO: 5 - protein, 58 aa, ARTIFICIAL SEQUENCE
  Engineered IL-6 binding polypeptide
VDAKYAKEEKQAWREIHLLPNLTIDQMAAFITKLFDDPSQSSELLSEAKKLNDSQAPK

SEQ ID NO: 6 - protein, 58 aa, ARTIFICIAL SEQUENCE
  Engineered IL-6 binding polypeptide
VDAKYAKEEKFAWWEIHKLPNLTVDQVAAFITKLFDDPSQSSELLSEAKKLNDSQAPK

SEQ ID NO: 7 - protein, 58 aa, ARTIFICIAL SEQUENCE
  Engineered IL-6 binding polypeptide
VDAKYAKEEREAWFEIHTLPNLTVSQMAAFISKLFDDPSQSSELLSEAKKLNDSQAPK

SEQ ID NO: 8 - protein, 58 aa, ARTIFICIAL SEQUENCE
  Engineered IL-6 binding polypeptide
VDAKYAKEERHAWFEIHKLPNLTVDQMAAFITKLFDDPSQSSELLSEAKKLNDSQAPK

SEQ ID NO: 9 - protein, 58 aa, ARTIFICIAL SEQUENCE
  Engineered IL-6 binding polypeptide
VDAKYAKEEYLAWNEIHKLPNLTVDQMAAFITKLFDDPSQSSELLSEAKKLNDSQAPK

SEQ ID NO: 10 - protein, 58 aa, ARTIFICIAL SEQUENCE
  Engineered IL-6 binding polypeptide
VDAKYAKEEAAAWREIHLLPNLTIDQMAAFITKLFDDPSQSSELLSEAKKLNDSQAPK

SEQ ID NO: 11 - protein, 58 aa, ARTIFICIAL SEQUENCE
  Engineered IL-6 binding polypeptide
VDAKYAKEEYEAWFEIHALPNLTVEQMAAFITKLFDDPSQSSELLSEAKKLNDSQAPK

SEQ ID NO: 12 - protein, 58 aa, ARTIFICIAL SEQUENCE
  Engineered IL-6 binding polypeptide
VDAKYAKEERRAWTEIHSLPNLTIDQMAAFITKLFDDPSQSSELLSEAKKLNDSQAPK

SEQ ID NO: 13 - protein, 58 aa, ARTIFICIAL SEQUENCE
  Engineered IL-6 binding polypeptide
VDAKYAKEERNAWYEIHLLPNLTVEQMAAFITKLFDDPSQSSELLSEAKKLNDSQAPK

SEQ ID NO: 14 - protein, 58 aa, ARTIFICIAL SEQUENCE
  Engineered IL-6 binding polypeptide
VDAKYAKEERMAWYEIHSLPNLTVDQMAAFITKLFDDPSQSSELLSEAKKLNDSQAPK

SEQ ID NO: 15 - protein, 58 aa, ARTIFICIAL SEQUENCE
  Engineered IL-6 binding polypeptide
VDAKYAKEEREAWYEIHVLPNLTVSQIAAFISKLFDDPSQSSELLSEAKKLNDSQAPK

SEQ ID NO: 16 - protein, 58 aa, ARTIFICIAL SEQUENCE
  Engineered IL-6 binding polypeptide
VDAKYAKEERTAWFEIHTLPNLTVEQMAAFISKLFDDPSQSSELLSEAKKLNDSQAPK

SEQ ID NO: 17 - protein, 58 aa, ARTIFICIAL SEQUENCE
  Engineered IL-6 binding polypeptide
VDAKYAKEEAEAWWEIHLLPNLTVSQMAAFISKLFDDPSQSSELLSEAKKLNDSQAPK

SEQ ID NO: 18 - protein, 58 aa, ARTIFICIAL SEQUENCE
  Engineered IL-6 binding polypeptide
VDAKYAKEEREAWYEIHLLPNLTVEQMAAFISKLFDDPSQSSELLSEAKKLNDSQAPK

SEQ ID NO: 19 - protein, 58 aa, ARTIFICIAL SEQUENCE
  Engineered IL-6 binding polypeptide
VDAKYAKEERDAWYEIHLLPNLTIDQMAAFISKLFDDPSQSSELLSEAKKLNDSQAPK

SEQ ID NO: 20 - protein, 58 aa, ARTIFICIAL SEQUENCE
  Engineered IL-6 binding polypeptide
VDAKYAKEERKAWFEIHALPNLTVDQMAAFISKLFDDPSQSSELLSEAKKLNDSQAPK

SEQ ID NO: 21 - protein, 58 aa, ARTIFICIAL SEQUENCE
  Engineered IL-6 binding polypeptide
VDAKYAKEEAKAWFEIHALPNLTVEQMAAFISKLFDDPSQSSELLSEAKKLNDSQAPK

SEQ ID NO: 22 - protein, 58 aa, ARTIFICIAL SEQUENCE
  Engineered IL-6 binding polypeptide
VDAKYAKEERTAWYEIHILPNLTVSQMAAFISKLFDDPSQSSELLSEAKKLNDSQAPK

SEQ ID NO: 23 - protein, 58 aa, ARTIFICIAL SEQUENCE
  Engineered IL-6 binding polypeptide
VDAKYAKEEQQAWTEIHSLPNLTVDQMAAFISKLFDDPSQSSELLSEAKKLNDSQAPK

SEQ ID NO: 24 - protein, 58 aa, ARTIFICIAL SEQUENCE
  Engineered IL-6 binding polypeptide
VDAKYAKEERDAWYEIHLLPNLTVEQIAAFISKLFDDPSQSSELLSEAKKLNDSQAPK

SEQ ID NO: 25 - protein, 58 aa, ARTIFICIAL SEQUENCE
  Engineered IL-6 binding polypeptide
VDAKYAKEERVAWYEIHLLPNLTITQMAAFISKLFDDPSQSSELLSEAKKLNDSQAPK

SEQ ID NO: 26 - protein, 58 aa, ARTIFICIAL SEQUENCE
  Engineered IL-6 binding polypeptide
VDAKYAKEERQAWYEIHLLPNLTVQQMAAFISKLFDDPSQSSELLSEAKKLNDSQAPK

SEQ ID NO: 27 - protein, 58 aa, ARTIFICIAL SEQUENCE
  Engineered IL-6 binding polypeptide
VDAKYAKEEASAWFEIHTLPNLTVQQMAAFISKLFDDPSQSSELLSEAKKLNDSQAPK

SEQ ID NO: 28 - protein, 58 aa, ARTIFICIAL SEQUENCE
  Engineered IL-6 binding polypeptide
VDAKYAKEEREAWYEIHVLPNLTVDQMAAFISKLFDDPSQSSELLSEAKKLNDSQAPK

SEQ ID NO: 29 - protein, 58 aa, ARTIFICIAL SEQUENCE
  Engineered IL-6 binding polypeptide
VDAKYAKEERKAWYEIHLLPNLTVNQMAAFISKLFDDPSQSSELLSEAKKLNDSQAPK

SEQ ID NO: 30 - protein, 58 aa, ARTIFICIAL SEQUENCE
  Engineered IL-6 binding polypeptide
VDAKYAKEERKAWYEIHLLPNLTVDQMAAFISKLFDDPSQSSELLSEAKKLNDSQAPK

SEQ ID NO: 31 - protein, 58 aa, ARTIFICIAL SEQUENCE
  Engineered IL-6 binding polypeptide
VDAKYAKEEARAWHEIHILPNLTVSQIAAFISKLFDDPSQSSELLSEAKKLNDSQAPK

SEQ ID NO: 32 - protein, 58 aa, ARTIFICIAL SEQUENCE
  Engineered IL-6 binding polypeptide
VDAKYAKEERAAWYEIHLLPNLTVDQMAAFISKLFDDPSQSSELLSEAKKLNDSQAPK

SEQ ID NO: 33 - protein, 58 aa, ARTIFICIAL SEQUENCE
  Engineered IL-6 binding polypeptide
VDAKYAKEERQAWYEIHTLPNLTAEQMAAFISKLFDDPSQSSELLSEAKKLNDSQAPK

SEQ ID NO: 34 - protein, 58 aa, ARTIFICIAL SEQUENCE
  Engineered IL-6 binding polypeptide
VDAKYAKEERQAWFEIHALPNLTVDQMAAFISKLFDDPSQSSELLSEAKKLNDSQAPK

SEQ ID NO: 35 - protein, 58 aa, ARTIFICIAL SEQUENCE
  Engineered IL-6 binding polypeptide
VDAKYAKEEARAWREIHLLPNLTVQQMAAFISKLFDDPSQSSELLSEAKKLNDSQAPK

SEQ ID NO: 36 - protein, 58 aa, ARTIFICIAL SEQUENCE
  Engineered IL-6 binding polypeptide
VDAKYAKEEAKAWREIHLLPNLTVTQMAAFISKLFDDPSQSSELLSEAKKLNDSQAPK

SEQ ID NO: 37 - protein, 58 aa, ARTIFICIAL SEQUENCE
  Engineered IL-6 binding polypeptide
VDAKYAKEEAEAWREIHLLPNLTVNQMAAFISKLFDDPSQSSELLSEAKKLNDSQAPK

SEQ ID NO: 38 - protein, 58 aa, ARTIFICIAL SEQUENCE
  Engineered IL-6 binding polypeptide
VDAKYAKEERDAWYEIHLLPNLTVQQMAAFISKLFDDPSQSSELLSEAKKLNDSQAPK

SEQ ID NO: 39 - protein, 58 aa, ARTIFICIAL SEQUENCE
  Engineered IL-6 binding polypeptide
VDAKYAKEEREAWYEIHLLPNLTVRQMAAFISKLFDDPSQSSELLSEAKKLNDSQAPK

SEQ ID NO: 40 - protein, 58 aa, ARTIFICIAL SEQUENCE
  Engineered IL-6 binding polypeptide
VDAKYAKEEREAWWEIHKLPNLTVNQMAAFISKLFDDPSQSSELLSEAKKLNDSQAPK

SEQ ID NO: 41 - protein, 58 aa, ARTIFICIAL SEQUENCE
  Engineered IL-6 binding polypeptide
VDAKYAKEERRAWYEIHLLPNLTIQQMAAFISKLFDDPSQSSELLSEAKKLNDSQAPK

SEQ ID NO: 42 - protein, 58 aa, ARTIFICIAL SEQUENCE
  Engineered IL-6 binding polypeptide
VDAKYAKEEAEAWREIHLLPNLTVHQMAAFISKLFDDPSQSSELLSEAKKLNDSQAPK

SEQ ID NO: 43 - protein, 58 aa, ARTIFICIAL SEQUENCE
  Engineered IL-6 binding polypeptide
VDAKYAKEERDAWHEIHLLPNLTVSQMAAFISKLFDDPSQSSELLSEAKKLNDSQAPK

SEQ ID NO: 44 - protein, 58 aa, ARTIFICIAL SEQUENCE
  Engineered IL-6 binding polypeptide
VDAKYAKEERRAWYEIHTLPNLTVQQMAAFISKLFDDPSQSSELLSEAKKLNDSQAPK

SEQ ID NO: 45 - protein, 58 aa, ARTIFICIAL SEQUENCE
  Engineered IL-6 binding polypeptide
VDAKYAKEERKAWFEIHKLPNLTVEQMAAFISKLFDDPSQSSELLSEAKKLNDSQAPK

SEQ ID NO: 46 - protein, 58 aa, ARTIFICIAL SEQUENCE
  Engineered IL-6 binding polypeptide
VDAKYAKEEHHAWTEIHLLPNLTVSQMAAFIQKLFDDPSQSSELLSEAKKLNDSQAPK

SEQ ID NO: 47 - protein, 58 aa, ARTIFICIAL SEQUENCE
  Engineered IL-6 binding polypeptide
VDAKYAKEEARAWFEIHALPNLTVQQVAAFISKLFDDPSQSSELLSEAKKLNDSQAPK

SEQ ID NO: 48 - protein, 58 aa, ARTIFICIAL SEQUENCE
  Engineered IL-6 binding polypeptide
VDAKYAKEEAKAWREIHILPNLTVQQMAAFISKLFDDPSQSSELLSEAKKLNDSQAPK

SEQ ID NO: 49 - protein, 58 aa, ARTIFICIAL SEQUENCE
  Engineered IL-6 binding polypeptide
VDAKYAKEEATAWHEIHTLPNLTVHQMAAFISKLFDDPSQSSELLSEAKKLNDSQAPK

SEQ ID NO: 50 - protein, 58 aa, ARTIFICIAL SEQUENCE
  Engineered IL-6 binding polypeptide
VDAKYAKEERSAWYEIHLLPNLTVTQMAAFISKLFDDPSQSSELLSEAKKLNDSQAPK

SEQ ID NO: 51 - protein, 58 aa, ARTIFICIAL SEQUENCE
  Engineered IL-6 binding polypeptide
VDAKYAKEERAAWFEIHTLPNLTVQQMAAFISKLFDDPSQSSELLSEAKKLNDSQAPK

SEQ ID NO: 52 - protein, 58 aa, ARTIFICIAL SEQUENCE
  Engineered IL-6 binding polypeptide
VDAKYAKEERTAWYEIHLLPNLTVTQMAAFISKLFDDPSQSSELLSEAKKLNDSQAPK

SEQ ID NO: 53 - protein, 58 aa, ARTIFICIAL SEQUENCE
  Engineered IL-6 binding polypeptide
VDAKYAKEERKAWFEIHALPNLTVSQMAAFISKLFDDPSQSSELLSEAKKLNDSQAPK

SEQ ID NO: 54 - protein, 58 aa, ARTIFICIAL SEQUENCE
  Engineered IL-6 binding polypeptide
VDAKYAKEEHRAWFEIHLLPNLTVEQMAAFISKLFDDPSQSSELLSEAKKLNDSQAPK

SEQ ID NO: 55 - protein, 58 aa, ARTIFICIAL SEQUENCE
  Engineered IL-6 binding polypeptide
VDAKYAKEERAAWYEIHILPNLTVQQMAAFIQKLFDDPSQSSELLSEAKKLNDSQAPK

SEQ ID NO: 56 - protein, 58 aa, ARTIFICIAL SEQUENCE
  Engineered IL-6 binding polypeptide
VDAKYAKEERQAWYEIHLLPNLTVSQIAAFISKLFDDPSQSSELLSEAKKLNDSQAPK

SEQ ID NO: 57 - protein, 58 aa, ARTIFICIAL SEQUENCE
  Engineered IL-6 binding polypeptide
VDAKYAKEEAAAWREIHLLPNLTVQQMAAFISKLFDDPSQSSELLSEAKKLNDSQAPK

SEQ ID NO: 58 - protein, 58 aa, ARTIFICIAL SEQUENCE
  Engineered IL-6 binding polypeptide
VDAKYAKEEREAWHEIHILPNLTIHQMAAFISKLFDDPSQSSELLSEAKKLNDSQAPK

SEQ ID NO: 59 - protein, 58 aa, ARTIFICIAL SEQUENCE
  Engineered IL-6 binding polypeptide
VDAKYAKEEAQAWLEIHLLPNLTVDQIAAFISKLFDDPSQSSELLSEAKKLNDSQAPK

SEQ ID NO: 60 - protein, 58 aa, ARTIFICIAL SEQUENCE
  Engineered IL-6 binding polypeptide
VDAKYAKEERKAWFEIHALPNLTVTQMAAFISKLFDDPSQSSELLSEAKKLNDSQAPK

SEQ ID NO: 61 - protein, 58 aa, ARTIFICIAL SEQUENCE
  Engineered IL-6 binding polypeptide
VDAKYAKEERDAWYEIHLLPNLTVEQMAAFISKLFDDPSQSSELLSEAKKLNDSQAPK

SEQ ID NO: 62 - protein, 58 aa, ARTIFICIAL SEQUENCE
  Engineered IL-6 binding polypeptide
VDAKYAKEEAAAWYEIHLLPNLTISQIAAFISKLFDDPSQSSELLSEAKKLNDSQAPK

SEQ ID NO: 63 - protein, 58 aa, ARTIFICIAL SEQUENCE
  Engineered IL-6 binding polypeptide
VDAKYAKEERVAWYEIHLLPNLTVRQMAAFISKLFDDPSQSSELLSEAKKLNDSQAPK

SEQ ID NO: 64 - protein, 58 aa, ARTIFICIAL SEQUENCE
  Engineered IL-6 binding polypeptide
VDAKYAKEEHHAWYEIHILPNLTVSQIAAFISKLFDDPSQSSELLSEAKKLNDSQAPK

SEQ ID NO: 65 - protein, 58 aa, ARTIFICIAL SEQUENCE
  Engineered IL-6 binding polypeptide
VDAKYAKEERAAWFEIHALPNLTVEQVAAFIIKLFDDPSQSSELLSEAKKLNDSQAPK

SEQ ID NO: 66 - protein, 58 aa, ARTIFICIAL SEQUENCE
  Engineered IL-6 binding polypeptide
VDAKYAKEEQEAWYEIHVLPNLTVTQMAAFISKLFDDPSQSSELLSEAKKLNDSQAPK

SEQ ID NO: 67 - protein, 58 aa, ARTIFICIAL SEQUENCE
  Engineered IL-6 binding polypeptide
VDAKYAKEEQQAWTEIHTLPNLTVDQMAAFISKLFDDPSQSSELLSEAKKLNDSQAPK

SEQ ID NO: 68 - protein, 58 aa, ARTIFICIAL SEQUENCE
  Engineered IL-6 binding polypeptide
VDAKYAKEERDAWYEIHLLPNLTVTQMAAFISKLFDDPSQSSELLSEAKKLNDSQAPK

SEQ ID NO: 69 - protein, 58 aa, ARTIFICIAL SEQUENCE
  Engineered IL-6 binding polypeptide
VDAKYAKEERDAWYEIHLLPNLTISQMAAFISKLFDDPSQSSELLSEAKKLNDSQAPK

SEQ ID NO: 70 - protein, 58 aa, ARTIFICIAL SEQUENCE
  Engineered IL-6 binding polypeptide
VDAKYAKEEREAWHEIHILPNLTVEQIAAFISKLFDDPSQSSELLSEAKKLNDSQAPK

SEQ ID NO: 71 - protein, 58 aa, ARTIFICIAL SEQUENCE
  Engineered IL-6 binding polypeptide
VDAKYAKEERDAWWEIHALPNLTVDQMAAFISKLFDDPSQSSELLSEAKKLNDSQAPK

SEQ ID NO: 72 - protein, 58 aa, ARTIFICIAL SEQUENCE
  Engineered IL-6 binding polypeptide
VDAKYAKEEARAWHEIHVLPNLTVSQMAAFIQKLFDDPSQSSELLSEAKKLNDSQAPK

SEQ ID NO: 73 - protein, 58 aa, ARTIFICIAL SEQUENCE
  Engineered IL-6 binding polypeptide
VDAKYAKEEAQAWYEIHTLPNLTVEQMAAFIAKLFDDPSQSSELLSEAKKLNDSQAPK

SEQ ID NO: 74 - protein, 58 aa, ARTIFICIAL SEQUENCE
  Engineered IL-6 binding polypeptide
VDAKYAKEERSAWWEIHTLPNLTVTQMAAFISKLFDDPSQSSELLSEAKKLNDSQAPK

SEQ ID NO: 75 - protein, 58 aa, ARTIFICIAL SEQUENCE
  Engineered IL-6 binding polypeptide
VDAKYAKEEADAWWEIHALPNLTIDQMAAFISKLFDDPSQSSELLSEAKKLNDSQAPK

SEQ ID NO: 76 - protein, 58 aa, ARTIFICIAL SEQUENCE
  Engineered IL-6 binding polypeptide
VDAKYAKEEAEAWYEIHLLPNLTVDQMAAFIIKLFDDPSQSSELLSEAKKLNDSQAPK

SEQ ID NO: 77 - protein, 58 aa, ARTIFICIAL SEQUENCE
  Engineered IL-6 binding polypeptide
VDAKYAKEERAAWYEIHSLPNLTVDQMAAFISKLFDDPSQSSELLSEAKKLNDSQAPK

SEQ ID NO: 78 - protein, 58 aa, ARTIFICIAL SEQUENCE
  Engineered IL-6 binding polypeptide
VDAKYAKEEQQAWLEIHLLPNLTIEQMAAFISKLFDDPSQSSELLSEAKKLNDSQAPK

SEQ ID NO: 79 - protein, 58 aa, ARTIFICIAL SEQUENCE
  Engineered IL-6 binding polypeptide
VDAKYAKEERDAWYEIHLLPNLTVHQIAAFISKLFDDPSQSSELLSEAKKLNDSQAPK

SEQ ID NO: 80 - protein, 58 aa, ARTIFICIAL SEQUENCE
  Engineered IL-6 binding polypeptide
VDAKYAKEERDAWYEIHTLPNLTVEQMAAFIWKLFDDPSQSSELLSEAKKLNDSQAPK

SEQ ID NO: 81 - protein, 58 aa, ARTIFICIAL SEQUENCE
  Engineered IL-6 binding polypeptide
VDAKYAKEEQHAWLEIHKLPNLTVEQIAAFISKLFDDPSQSSELLSEAKKLNDSQAPK

SEQ ID NO: 82 - protein, 58 aa, ARTIFICIAL SEQUENCE
  Engineered IL-6 binding polypeptide
VDAKYAKEEAAAWFEIHTLPNLTVDQMAAFISKLFDDPSQSSELLSEAKKLNDSQAPK

SEQ ID NO: 83 - protein, 58 aa, ARTIFICIAL SEQUENCE
  Engineered IL-6 binding polypeptide
VDAKYAKEERDAWFEIHTLPNLTVTQMAAFIIKLFDDPSQSSELLSEAKKLNDSQAPK

SEQ ID NO: 84 - protein, 58 aa, ARTIFICIAL SEQUENCE
  Engineered IL-6 binding polypeptide
VDAKYAKEERHAWHEIHILPNLTANQIAAFISKLFDDPSQSSELLSEAKKLNDSQAPK

SEQ ID NO: 85 - protein, 58 aa, ARTIFICIAL SEQUENCE
  Engineered IL-6 binding polypeptide
VDAKYAKEEREAWFEIHLLPNLTISQMAAFISKLFDDPSQSSELLSEAKKLNDSQAPK

SEQ ID NO: 86 - protein, 58 aa, ARTIFICIAL SEQUENCE
  Engineered IL-6 binding polypeptide
VDAKYAKEEAEAWWEIHLLPNLTVQQIAAFISKLFDDPSQSSELLSEAKKLNDSQAPK

SEQ ID NO: 87 - protein, 58 aa, ARTIFICIAL SEQUENCE
  Engineered IL-6 binding polypeptide
VDAKYAKEEAHAWYEIHILPNLTVSQMAAFISKLFDDPSQSSELLSEAKKLNDSQAPK

SEQ ID NO: 88 - protein, 58 aa, ARTIFICIAL SEQUENCE
  Engineered IL-6 binding polypeptide
VDAKYAKEERDAWYEIHLLPNLTIDQIAAFISKLFDDPSQSSELLSEAKKLNDSQAPK

SEQ ID NO: 89 - protein, 58 aa, ARTIFICIAL SEQUENCE
  Engineered IL-6 binding polypeptide
VDAKYAKEEQRAWREIHLLPNLTIEQMSAFISKLFDDPSQSSELLSEAKKLNDSQAPK

SEQ ID NO: 90 - protein, 58 aa, ARTIFICIAL SEQUENCE
  Engineered IL-6 binding polypeptide
VDAKYAKEEYDAWMEIHLLPNLTVDQMAAFITKLFDDPSQSSELLSEAKKLNDSQAPK

SEQ ID NO: 91 - protein, 58 aa, ARTIFICIAL SEQUENCE
  Engineered IL-6 binding polypeptide
VDAKYAKEEKHAWREIHLLPNLTVEQMAAFITKLFDDPSQSSELLSEAKKLNDSQAPK

SEQ ID NO: 92 - protein, 58 aa, ARTIFICIAL SEQUENCE
  Engineered IL-6 binding polypeptide
VDAKYAKEEKKAWTEIHLLPNLTIEQMAAFITKLFDDPSQSSELLSEAKKLNDSQAPK

SEQ ID NO: 93 - protein, 58 aa, ARTIFICIAL SEQUENCE
  Engineered IL-6 binding polypeptide
VDAKYAKEERFAWTEIHLLPNLTVDQMAAFITKLFDDPSQSSELLSEAKKLNDSQAPK

SEQ ID NO: 94 - protein, 58 aa, ARTIFICIAL SEQUENCE
  Engineered IL-6 binding polypeptide
VDAKYAKEERHAWTEIHLLPNLTIDQMAAFITKLFDDPSQSSELLSEAKKLNDSQAPK

SEQ ID NO: 95 - protein, 58 aa, ARTIFICIAL SEQUENCE
  Engineered IL-6 binding polypeptide
VDAKYAKEERAAWFEIHALPNLTVEQVAAFITKLFDDPSQSSELLSEAKKLNDSQAPK

SEQ ID NO: 96 - protein, 58 aa, ARTIFICIAL SEQUENCE
  Engineered IL-6 binding polypeptide
VDAKYAKEEKQAWYEIHNLPNLTVDQMAAFISKLFDDPSQSSELLSEAKKLNDSQAPK

SEQ ID NO: 97 - protein, 58 aa, ARTIFICIAL SEQUENCE
  Engineered IL-6 binding polypeptide
VDAKYAKEEAQAWWEIHALPNLTVDQVAAFITKLFDDPSQSSELLSEAKKLNDSQAPK

SEQ ID NO: 98 - protein, 58 aa, ARTIFICIAL SEQUENCE
  Engineered IL-6 binding polypeptide
VDAKYAKEEYEAWYEIHILPNLTVDQIAAFITKLFDDPSQSSELLSEAKKLNDSQAPK

SEQ ID NO: 99 - protein, 58 aa, ARTIFICIAL SEQUENCE
  Engineered IL-6 binding polypeptide
VDAKYAKEEYEAWHEIHILPNLTVDQMAAFITKLFDDPSQSSELLSEAKKLNDSQAPK

SEQ ID NO: 100 - protein, 58 aa, ARTIFICIAL SEQUENCE
  Engineered IL-6 binding polypeptide
VDAKYAKEERMAWMEIHLLPNLTVEQMAAFISKLFDDPSQSSELLSEAKKLNDSQAPK

SEQ ID NO: 101 - protein, 58 aa, ARTIFICIAL SEQUENCE
  Engineered IL-6 binding polypeptide
VDAKYAKEEYDAWVEIHALPNLTVEQVAAFITKLFDDPSQSSELLSEAKKLNDSQAPK

SEQ ID NO: 102 - protein, 58 aa, ARTIFICIAL SEQUENCE
  Engineered IL-6 binding polypeptide
VDAKYAKEEYEAWVEIHKLPNLTIDQMAAFITKLFDDPSQSSELLSEAKKLNDSQAPK

SEQ ID NO: 103 - protein, 58 aa, ARTIFICIAL SEQUENCE
  Engineered IL-6 binding polypeptide
VDAKYAKEEYHAWYEIHLLPNLTIDQMAAFITKLFDDPSQSSELLSEAKKLNDSQAPK

SEQ ID NO: 104 - protein, 58 aa, ARTIFICIAL SEQUENCE
  Engineered IL-6 binding polypeptide
VDAKYAKEEKDAWYEIHLLPNLTVEQIAAFITKLFDDPSQSSELLSEAKKLNDSQAPK

SEQ ID NO: 105 - protein, 58 aa, ARTIFICIAL SEQUENCE
  Engineered IL-6 binding polypeptide
VDAKYAKEEKHAWHEIHILPNLTVEQMAAFITKLFDDPSQSSELLSEAKKLNDSQAPK

SEQ ID NO: 106 - protein, 58 aa, ARTIFICIAL SEQUENCE
  Engineered IL-6 binding polypeptide
VDAKYAKEEKAAWFEIHALPNLTVEQVAAFITKLFDDPSQSSELLSEAKKLNDSQAPK

SEQ ID NO: 107 - protein, 58 aa, ARTIFICIAL SEQUENCE
  Engineered IL-6 binding polypeptide
VDAKYAKEEYHAWMEIHLLPNLTVSQMAAFITKLFDDPSQSSELLSEAKKLNDSQAPK

SEQ ID NO: 108 - protein, 58 aa, ARTIFICIAL SEQUENCE
  Engineered IL-6 binding polypeptide
VDAKYAKEEAFAWKEIHLLPNLTIDQMAAFITKLFDDPSQSSELLSEAKKLNDSQAPK

SEQ ID NO: 109 - protein, 58 aa, ARTIFICIAL SEQUENCE
  Engineered IL-6 binding polypeptide
VDAKYAKEEYEAWYEIHLLPNLTVSQIAAFITKLFDDPSQSSELLSEAKKLNDSQAPK

SEQ ID NO: 110 - protein, 58 aa, ARTIFICIAL SEQUENCE
  Engineered IL-6 binding polypeptide
VDAKYAKEEYYAWWEIHKLPNLTVDQMAAFITKLFDDPSQSSELLSEAKKLNDSQAPK

SEQ ID NO: 111 - protein, 58 aa, ARTIFICIAL SEQUENCE
  Engineered IL-6 binding polypeptide
VDAKYAKEEAVAWKEIHILPNLTVSQMAAFITKLFDDPSQSSELLSEAKKLNDSQAPK

SEQ ID NO: 112 - protein, 58 aa, ARTIFICIAL SEQUENCE
  Engineered IL-6 binding polypeptide
VDAKYAKEEKAAWYEIHLLPNLTIEQMAAFISKLFDDPSQSSELLSEAKKLNDSQAPK

SEQ ID NO: 113 - protein, 58 aa, ARTIFICIAL SEQUENCE
  Engineered IL-6 binding polypeptide
VDAKYAKEERAAWTEIHLLPNLTVEQMAAFITKLFDDPSQSSELLSEAKKLNDSQAPK

SEQ ID NO: 114 - protein, 58 aa, ARTIFICIAL SEQUENCE
  Engineered IL-6 binding polypeptide
VDAKYAKEERMAWYEIHTLPNLTVEQMAAFITKLFDDPSQSSELLSEAKKLNDSQAPK

SEQ ID NO: 115 - protein, 58 aa, ARTIFICIAL SEQUENCE
  Engineered IL-6 binding polypeptide
VDAKYAKEEHHAWREIHLLPNLTVDQMAAFITKLFDDPSQSSELLSEAKKLNDSQAPK

SEQ ID NO: 116 - protein, 58 aa, ARTIFICIAL SEQUENCE
  Engineered IL-6 binding polypeptide
VDAKYAKEEAKAWMEIHLLPNLTIDQMAAFITKLFDDPSQSSELLSEAKKLNDSQAPK

SEQ ID NO: 117 - protein, 58 aa, ARTIFICIAL SEQUENCE
  Engineered IL-6 binding polypeptide
VDAKYAKEEKAAWYEIHLLPNLTVDQIAAFITKLFDDPSQSSELLSEAKKLNDSQAPK

SEQ ID NO: 118 - protein, 58 aa, ARTIFICIAL SEQUENCE
  Engineered IL-6 binding polypeptide
VDAKYAKEEKHAWMEIHKLPNLTVDQMAAFITKLFDDPSQSSELLSEAKKLNDSQAPK

SEQ ID NO: 119 - protein, 58 aa, ARTIFICIAL SEQUENCE
  Engineered IL-6 binding polypeptide
VDAKYAKEEKAAWNEIHKLPNLTVDQMAAFITKLFDDPSQSSELLSEAKKLNDSQAPK

SEQ ID NO: 120 - protein, 58 aa, ARTIFICIAL SEQUENCE
  Engineered IL-6 binding polypeptide
VDAKYAKEERKAWVEIHNLPNLTVDQMAAFITKLFDDPSQSSELLSEAKKLNDSQAPK

SEQ ID NO: 121 - protein, 58 aa, ARTIFICIAL SEQUENCE
  Engineered IL-6 binding polypeptide
VDAKYAKEEAIAWHEIHVLPNLTVDQIAAFITKLFDDPSQSSELLSEAKKLNDSQAPK

SEQ ID NO: 122 - protein, 58 aa, ARTIFICIAL SEQUENCE
  Engineered IL-6 binding polypeptide
VDAKYAKEEYEAWYEIHLLPNLTIQQMAAFISKLFDDPSQSSELLSEAKKLNDSQAPK

SEQ ID NO: 123 - protein, 58 aa, ARTIFICIAL SEQUENCE
  Engineered IL-6 binding polypeptide
VDAKYAKEEYHAWVEIHNLPNLTIDQMAAFITKLFDDPSQSSELLSEAKKLNDSQAPK

SEQ ID NO: 124 - protein, 58 aa, ARTIFICIAL SEQUENCE
  Engineered IL-6 binding polypeptide
VDAKYAKEEAFAWREIHLLPNLTIDQMAAFITKLFDDPSQSSELLSEAKKLNDSQAPK

SEQ ID NO: 125 - protein, 58 aa, ARTIFICIAL SEQUENCE
  Engineered IL-6 binding polypeptide
VDAKYAKEEKEAWYEIHLLPNLTVSQMAAFITKLFDDPSQSSELLSEAKKLNDSQAPK

SEQ ID NO: 126 - protein, 58 aa, ARTIFICIAL SEQUENCE
  Engineered IL-6 binding polypeptide
VDAKYAKEERKAWYEIHLLPNLTIDQMAAFITKLFDDPSQSSELLSEAKKLNDSQAPK

SEQ ID NO: 127 - protein, 58 aa, ARTIFICIAL SEQUENCE
  Engineered IL-6 binding polypeptide
VDAKYAKEEYDAWYEIHTLPNLTVDQMAAFISKLFDDPSQSSELLSEAKKLNDSQAPK

SEQ ID NO: 128 - protein, 58 aa, ARTIFICIAL SEQUENCE
  Engineered IL-6 binding polypeptide
VDAKYAKEERNAWTEIHLLPNLTIEQMAAFITKLFDDPSQSSELLSEAKKLNDSQAPK

SEQ ID NO: 129 - protein, 58 aa, ARTIFICIAL SEQUENCE
  Engineered IL-6 binding polypeptide
VDAKYAKEEYKAWLEIHNLPNLTVDQMAAFITKLFDDPSQSSELLSEAKKLNDSQAPK

SEQ ID NO: 130 - protein, 58 aa, ARTIFICIAL SEQUENCE
  Engineered IL-6 binding polypeptide
VDAKYAKEEYEAWMEIHLLPNLTVEQIAAFITKLFDDPSQSSELLSEAKKLNDSQAPK

SEQ ID NO: 131 - protein, 58 aa, ARTIFICIAL SEQUENCE
  Engineered IL-6 binding polypeptide
VDAKYAKEERDAWFEIHKLPNLTVDQMAAFITKLFDDPSQSSELLSEAKKLNDSQAPK

SEQ ID NO: 132 - protein, 58 aa, ARTIFICIAL SEQUENCE
  Engineered IL-6 binding polypeptide
VDAKYAKEEAYAWKEIHLLPNLTVDQMAAFITKLFDDPSQSSELLSEAKKLNDSQAPK

SEQ ID NO: 133 - protein, 58 aa, ARTIFICIAL SEQUENCE
  Engineered IL-6 binding polypeptide
VDAKYAKEEYFAWWEIHKLPNLTVNQMAAFITKLFDDPSQSSELLSEAKKLNDSQAPK

SEQ ID NO: 134 - protein, 58 aa, ARTIFICIAL SEQUENCE
  Engineered IL-6 binding polypeptide
VDAKYAKEEKQAWVEIHNLPNLTITQMAAFITKLFDDPSQSSELLSEAKKLNDSQAPK

SEQ ID NO: 135 - protein, 58 aa, ARTIFICIAL SEQUENCE
  Engineered IL-6 binding polypeptide
VDAKYAKEEQRAWYEIHILPNLTIDQMAAFITKLFDDPSQSSELLSEAKKLNDSQAPK

SEQ ID NO: 136 - protein, 58 aa, ARTIFICIAL SEQUENCE
  Engineered IL-6 binding polypeptide
VDAKYAKEEARAWREIHALPNLTIDQMAAFITKLFDDPSQSSELLSEAKKLNDSQAPK

SEQ ID NO: 137 - protein, 58 aa, ARTIFICIAL SEQUENCE
  Engineered IL-6 binding polypeptide
VDAKYAKEERYAWNEIHKLPNLTVDQMAAFITKLFDDPSQSSELLSEAKKLNDSQAPK

SEQ ID NO: 138 - protein, 58 aa, ARTIFICIAL SEQUENCE
  Engineered IL-6 binding polypeptide
VDAKYAKEEAKAWYEIHILPNLTVDQIAAFITKLFDDPSQSSELLSEAKKLNDSQAPK

SEQ ID NO: 139 - protein, 58 aa, ARTIFICIAL SEQUENCE
  Engineered IL-6 binding polypeptide
VDAKYAKEEARAWHEIHILPNLTIDQMAAFITKLFDDPSQSSELLSEAKKLNDSQAPK

SEQ ID NO: 140 - protein, 58 aa, ARTIFICIAL SEQUENCE
  Engineered IL-6 binding polypeptide
VDAKYAKEEKKAWYEIHLLPNLTIEQMAAFITKLFDDPSQSSELLSEAKKLNDSQAPK

SEQ ID NO: 141 - protein, 58 aa, ARTIFICIAL SEQUENCE
  Engineered IL-6 binding polypeptide
VDAKYAKEEARAWTEIHLLPNLTVDQMAAFITKLFDDPSQSSELLSEAKKLNDSQAPK

SEQ ID NO: 142 - protein, 58 aa, ARTIFICIAL SEQUENCE
  Engineered IL-6 binding polypeptide
VDAKYAKEERSAWMEIHLLPNLTVDQMAAFITKLFDDPSQSSELLSEAKKLNDSQAPK

SEQ ID NO: 143 - protein, 58 aa, ARTIFICIAL SEQUENCE
  Engineered IL-6 binding polypeptide
VDAKYAKEEREAWFEIHILPNLTIDQMAAFITKLFDDPSQSSELLSEAKKLNDSQAPK

SEQ ID NO: 144 - protein, 58 aa, ARTIFICIAL SEQUENCE
  Engineered IL-6 binding polypeptide
VDAKYAKEEYEAWTEIHLLPNLTIEQMAAFITKLFDDPSQSSELLSEAKKLNDSQAPK

SEQ ID NO: 145 - protein, 58 aa, ARTIFICIAL SEQUENCE
  Engineered IL-6 binding polypeptide
VDAKYAKEEYEAWVEIHNLPNLTITQMAAFITKLFDDPSQSSELLSEAKKLNDSQAPK

SEQ ID NO: 146 - protein, 58 aa, ARTIFICIAL SEQUENCE
  Engineered IL-6 binding polypeptide
VDAKYAKEEYKAWHEIHILPNLTVDQMAAFITKLFDDPSQSSELLSEAKKLNDSQAPK

SEQ ID NO: 147 - protein, 58 aa, ARTIFICIAL SEQUENCE
  Engineered IL-6 binding polypeptide
VDAKYAKEEREAWMEIHLLPNLTIDQMAAFITKLFDDPSQSSELLSEAKKLNDSQAPK

SEQ ID NO: 148 - protein, 58 aa, ARTIFICIAL SEQUENCE
  Engineered IL-6 binding polypeptide
VDAKYAKEEYKAWVEIHLLPNLTVDQIAAFITKLFDDPSQSSELLSEAKKLNDSQAPK

SEQ ID NO: 149 - protein, 58 aa, ARTIFICIAL SEQUENCE
  Engineered IL-6 binding polypeptide
VDAKYAKEEKIAWYEIHLLPNLTVNQIAAFITKLFDDPSQSSELLSEAKKLNDSQAPK

SEQ ID NO: 150 - protein, 58 aa, ARTIFICIAL SEQUENCE
  Engineered IL-6 binding polypeptide
VDAKYAKEEAYAWKEIHLLPNLTIEQMAAFISKLFDDPSQSSELLSEAKKLNDSQAPK

SEQ ID NO: 151 - protein, 58 aa, ARTIFICIAL SEQUENCE
  Engineered IL-6 binding polypeptide
VDAKYAKEEQVAWWEISHLPNLTITQVVAFIQKLFDDPSQSSELLSEAKKLNDSQAPK

SEQ ID NO: 152 - protein, 58 aa, ARTIFICIAL SEQUENCE
  Engineered IL-6 binding polypeptide
VDAKYAKEEQVAWWEISHLPNLTIEQVVAFIQKLFDDPSQSSELLSEAKKLNDSQAPK

SEQ ID NO: 153 - protein, 58 aa, ARTIFICIAL SEQUENCE
  Engineered IL-6 binding polypeptide
VDAKYAKEEREAWYEIHTLPNLTAQQMAAFIVKLYDDPSQSSELLSEAKKLNDSQAPK

SEQ ID NO: 154 - protein, 58 aa, ARTIFICIAL SEQUENCE
  Engineered IL-6 binding polypeptide
VDAKYAKEEAQAWLEIHLLPNLTVDQMAAFISKLFDDPSQSSELLSEAKKLNDSQAPK

SEQ ID NO: 155 - protein, 58 aa, ARTIFICIAL SEQUENCE
  Engineered IL-6 binding polypeptide
VDAKYAKEERHAWFEIHSLPNLTVNQMSAFISKLFDDPSQSSELLSEAKKLNDSQAPK

SEQ ID NO: 156 - protein, 58 aa, ARTIFICIAL SEQUENCE
  Engineered IL-6 binding polypeptide
VDAKYAKEEADAWWEIHALPNLTVDQMAAFISKLFDDPSQSSELLSEAKKLNDSQAPK

SEQ ID NO: 157 - protein, 58 aa, ARTIFICIAL SEQUENCE
  Engineered IL-6 binding polypeptide
VDAKYAKEEARAWLEIHALPNLTVTQMAAFIIKLYDDPSQSSELLSEAKKLNDSQAPK

SEQ ID NO: 158 - protein, 58 aa, ARTIFICIAL SEQUENCE
  Engineered IL-6 binding polypeptide
VDAKYAKEERRAWTEIHLLPNLTVDQMAAFISKLFDDPSQSSELLSEAKKLNDSQAPK

SEQ ID NO: 159 - protein, 58 aa, ARTIFICIAL SEQUENCE
  Engineered IL-6 binding polypeptide
VDAKYAKEERHAWYEIHTLPNLTVTQMSAFIQKLFDDPSQSSELLSEAKKLNDSQAPK

SEQ ID NO: 160 - protein, 58 aa, ARTIFICIAL SEQUENCE
  Engineered IL-6 binding polypeptide
VDAKYAKEEAQAWFEIHLLPNLTIDQMAAFISKLFDDPSQSSELLSEAKKLNDSQAPK

SEQ ID NO: 161 - protein, 58 aa, ARTIFICIAL SEQUENCE
  Engineered IL-6 binding polypeptide
VDAKYAKEERAAWHEIHVLPNLTVSQMAAFIIKLFDDPSQSSELLSEAKKLNDSQAPK

SEQ ID NO: 162 - protein, 58 aa, ARTIFICIAL SEQUENCE
  Engineered IL-6 binding polypeptide
VDAKYAKEEREAWYEIHVLPNLTVHQRAAFISKLFDDPSQSSELLSEAKKLNDSQAPK

SEQ ID NO: 163 - protein, 58 aa, ARTIFICIAL SEQUENCE
  Engineered IL-6 binding polypeptide
VDAKYAKEERHAWYEIHLLPNLTVHQIAAFISKLFDDPSQSSELLSEAKKLNDSQAPK

SEQ ID NO: 164 - protein, 58 aa, ARTIFICIAL SEQUENCE
  Engineered IL-6 binding polypeptide
VDAKYAKEERHAWFEIHTLPNLTINQRTAFIQKLFDDPSQSSELLSEAKKLNDSQAPK

SEQ ID NO: 165 - protein, 58 aa, ARTIFICIAL SEQUENCE
  Engineered IL-6 binding polypeptide
VDAKYAKEERHAWYEIHVLPNLTVSQMAAFIMKLFDDPSQSSELLSEAKKLNDSQAPK

SEQ ID NO: 166 - protein, 58 aa, ARTIFICIAL SEQUENCE
  Engineered IL-6 binding polypeptide
VDAKYAKEERDAWLEIHMLPNLTITQVAAFISKLFDDPSQSSELLSEAKKLNDSQAPK

SEQ ID NO: 167 - protein, 58 aa, ARTIFICIAL SEQUENCE
  Engineered IL-6 binding polypeptide
VDAKYAKEEARAWHEIHVLPNLTAEQMAAFISKLFDDPSQSSELLSEAKKLNDSQAPK

SEQ ID NO: 168 - protein, 58 aa, ARTIFICIAL SEQUENCE
  Engineered IL-6 binding polypeptide
VDAKYAKEEAEAWLEIHLLPNLTVEQITAFISKLFDDPSQSSELLSEAKKLNDSQAPK

SEQ ID NO: 169 - protein, 58 aa, ARTIFICIAL SEQUENCE
  Engineered IL-6 binding polypeptide
VDAKYAKEERDAWHEIHLLPNLTVEQRAAFISKLFDDPSQSSELLSEAKKLNDSQAPK

SEQ ID NO: 170 - protein, 58 aa, ARTIFICIAL SEQUENCE
  Engineered IL-6 binding polypeptide
VDAKYAKEERKAWTEIHSLPNLTVTQMAAFISKLFDDPSQSSELLSEAKKLNDSQAPK

SEQ ID NO: 171 - protein, 58 aa, ARTIFICIAL SEQUENCE
  Engineered IL-6 binding polypeptide
VDAKYAKEERDAWHEIHILPNLTVEQMSAFISKLFDDPSQSSELLSEAKKLNDSQAPK

SEQ ID NO: 172 - protein, 58 aa, ARTIFICIAL SEQUENCE
  Engineered IL-6 binding polypeptide
VDAKYAKEEAEAWFEIHALPNLTAEQMAAFISKLFDDPSQSSELLSEAKKLNDSQAPK

SEQ ID NO: 173 - protein, 58 aa, ARTIFICIAL SEQUENCE
  Engineered IL-6 binding polypeptide
VDAKYAKEEHQAWWEIHLLPNLTVDQMSAFISKLFDDPSQSSELLSEAKKLNDSQAPK

SEQ ID NO: 174 - protein, 58 aa, ARTIFICIAL SEQUENCE
  Engineered IL-6 binding polypeptide
VDAKYAKEERDAWHEIHKLPNLTVNQVAAFISKLFDDPSQSSELLSEAKKLNDSQAPK

SEQ ID NO: 175 - protein, 58 aa, ARTIFICIAL SEQUENCE
  Engineered IL-6 binding polypeptide
VDAKYAKEEADAWFEIHLLPNLTVDQIAAFIQKLFDDPSQSSELLSEAKKLNDSQAPK

SEQ ID NO: 176 - protein, 58 aa, ARTIFICIAL SEQUENCE
  Engineered IL-6 binding polypeptide
VDAKYAKEERAAWYEIHVLPNLTVEQMAAFIQKLFDDPSQSSELLSEAKKLNDSQAPK

SEQ ID NO: 177 - protein, 58 aa, ARTIFICIAL SEQUENCE
  Engineered IL-6 binding polypeptide
VDAKYAKEEHRAWHEIHLLPNLTVNQIAAFISKLFDDPSQSSELLSEAKKLNDSQAPK

SEQ ID NO: 178 - protein, 58 aa, ARTIFICIAL SEQUENCE
  Engineered IL-6 binding polypeptide
VDAKYAKEEAVAWHEIHMLPNLTVEQMAAFISKLFDDPSQSSELLSEAKKLNDSQAPK

SEQ ID NO: 179 - protein, 58 aa, ARTIFICIAL SEQUENCE
  Engineered IL-6 binding polypeptide
VDAKYAKEEREAWWEIHALPNLTVSQMAAFISKLFDDPSQSSELLSEAKKLNDSQAPK

SEQ ID NO: 180 - protein, 58 aa, ARTIFICIAL SEQUENCE
  Engineered IL-6 binding polypeptide
VDAKYAKEERKAWFEIHSLPNLTVDQMSAFISKLFDDPSQSSELLSEAKKLNDSQAPK

SEQ ID NO: 181 - protein, 58 aa, ARTIFICIAL SEQUENCE
  Engineered IL-6 binding polypeptide
VDAKYAKEEQRAWWEIHTLPNLTTDQMAAFISKLFDDPSQSSELLSEAKKLNDSQAPK

SEQ ID NO: 182 - protein, 58 aa, ARTIFICIAL SEQUENCE
  Engineered IL-6 binding polypeptide
VDAKYAKEERQAWFEIHALPNLTVDQAAAFIIKLYDDPSQSSELLSEAKKLNDSQAPK

SEQ ID NO: 183 - protein, 58 aa, ARTIFICIAL SEQUENCE
  Engineered IL-6 binding polypeptide
VDAKYAKEEARAWTEIHALPNLTVDQMAAFIIKLYDDPSQSSELLSEAKKLNDSQAPK

SEQ ID NO: 184 - protein, 58 aa, ARTIFICIAL SEQUENCE
  Engineered IL-6 binding polypeptide
VDAKYAKEERRAWHEIHMLPNLTVTQMSAFISKLFDDPSQSSELLSEAKKLNDSQAPK

SEQ ID NO: 185 - protein, 58 aa, ARTIFICIAL SEQUENCE
  Engineered IL-6 binding polypeptide
VDAKYAKEEAKAWLEIHKLPNLTVNQMAAFISKLFDDPSQSSELLSEAKKLNDSQAPK

SEQ ID NO: 186 - protein, 58 aa, ARTIFICIAL SEQUENCE
  Engineered IL-6 binding polypeptide
VDAKYAKEEREAWHEIHLLPNLTISQIAAFISKLFDDPSQSSELLSEAKKLNDSQAPK

SEQ ID NO: 187 - protein, 58 aa, ARTIFICIAL SEQUENCE
  Engineered IL-6 binding polypeptide
VDAKYAKEEQHAWYEIHLLPNLTVTQMAAFISKLFDDPSQSSELLSEAKKLNDSQAPK

SEQ ID NO: 188 - protein, 58 aa, ARTIFICIAL SEQUENCE
  Engineered IL-6 binding polypeptide
VDAKYAKEEHKAWFEIHLLPNLTISQMAAFISKLFDDPSQSSELLSEAKKLNDSQAPK

SEQ ID NO: 189 - protein, 58 aa, ARTIFICIAL SEQUENCE
  Engineered IL-6 binding polypeptide
VDAKYAKEERRAWYEIHLLPNLTVTQMTAFISKLFDDPSQSSELLSEAKKLNDSQAPK

SEQ ID NO: 190 - protein, 58 aa, ARTIFICIAL SEQUENCE
  Engineered IL-6 binding polypeptide
VDAKYAKEERHAWTEIHILPNLTVRQMAAFISKLFDDPSQSSELLSEAKKLNDSQAPK

SEQ ID NO: 191 - protein, 58 aa, ARTIFICIAL SEQUENCE
  Engineered IL-6 binding polypeptide
VDAKYAKEERHAWHEIHLLPNLTIQQMAAFISKLFDDPSQSSELLSEAKKLNDSQAPK

SEQ ID NO: 192 - protein, 58 aa, ARTIFICIAL SEQUENCE
  Engineered IL-6 binding polypeptide
VDAKYAKEEQHAWTEIHKLPNLTIQQMAAFIQKLFDDPSQSSELLSEAKKLNDSQAPK

SEQ ID NO: 193 - protein, 58 aa, ARTIFICIAL SEQUENCE
  Engineered IL-6 binding polypeptide
VDAKYAKEEHRAWTEIHLLPNLTVSQMVAFISKLFDDPSQSSELLSEAKKLNDSQAPK

SEQ ID NO: 194 - protein, 58 aa, ARTIFICIAL SEQUENCE
  Engineered IL-6 binding polypeptide
VDAKYAKEEQDAWYEIHVLPNLTVEQLVAFISKLFDDPSQSSELLSEAKKLNDSQAPK

SEQ ID NO: 195 - protein, 58 aa, ARTIFICIAL SEQUENCE
  Engineered IL-6 binding polypeptide
VDAKYAKEEREAWHEIHSLPNLTVDQMTAFIIKLMDDPSQSSELLSEAKKLNDSQAPK

SEQ ID NO: 196 - protein, 58 aa, ARTIFICIAL SEQUENCE
  Engineered IL-6 binding polypeptide
VDAKYAKEEAAAWFEIHLLPNLTTEQMAAFIMKLFDDPSQSSELLSEAKKLNDSQAPK

SEQ ID NO: 197 - protein, 58 aa, ARTIFICIAL SEQUENCE
  Engineered IL-6 binding polypeptide
VDAKYAKEERAAWYEIHILPNLTVRQMAAFISKLFDDPSQSSELLSEAKKLNDSQAPK

SEQ ID NO: 198 - protein, 58 aa, ARTIFICIAL SEQUENCE
  Engineered IL-6 binding polypeptide
VDAKYAKEEARAWTEIHALPNLTVDQVTAFIIKLYDDPSQSSELLSEAKKLNDSQAPK

SEQ ID NO: 199 - protein, 58 aa, ARTIFICIAL SEQUENCE
  Engineered IL-6 binding polypeptide
VDAKYAKEEQRAWFEIHTLPNLTVDQIEAFISKLFDDPSQSSELLSEAKKLNDSQAPK

SEQ ID NO: 200 - protein, 58 aa, ARTIFICIAL SEQUENCE
  Engineered IL-6 binding polypeptide
VDAKYAKEEAAAWHEIHILPNLTVSQMAAFISKLFDDPSQSSELLSEAKKLNDSQAPK

SEQ ID NO: 201 - protein, 58 aa, ARTIFICIAL SEQUENCE
  Engineered IL-6 binding polypeptide
VDAKYAKEEAQAWWEIHSLPNLTVEQTSAFIQKLFDDPSQSSELLSEAKKLNDSQAPK

SEQ ID NO: 202 - protein, 58 aa, ARTIFICIAL SEQUENCE
  Engineered IL-6 binding polypeptide
VDAKYAKEEREAWHEIHALPNLTIDQRVAFISKLFDDPSQSSELLSEAKKLNDSQAPK

SEQ ID NO: 203 - protein, 58 aa, ARTIFICIAL SEQUENCE
  Engineered IL-6 binding polypeptide
VDAKYAKEEREAWYEIHLLPNLTINQMAAFISKLFDDPSQSSELLSEAKKLNDSQAPK

SEQ ID NO: 204 - protein, 58 aa, ARTIFICIAL SEQUENCE
  Engineered IL-6 binding polypeptide
VDAKYAKEERDAWYEIHLLPNLTIRQMAAFISKLFDDPSQSSELLSEAKKLNDSQAPK

SEQ ID NO: 205 - protein, 58 aa, ARTIFICIAL SEQUENCE
  Engineered IL-6 binding polypeptide
VDAKYAKEEQKAWTEIHLLPNLTVHQIAAFISKLFDDPSQSSELLSEAKKLNDSQAPK

SEQ ID NO: 206 - protein, 58 aa, ARTIFICIAL SEQUENCE
  Engineered IL-6 binding polypeptide
VDAKYAKEERAAWREIHLLPNLTTEQRTAFISKLFDDPSQSSELLSEAKKLNDSQAPK

SEQ ID NO: 207 - protein, 58 aa, ARTIFICIAL SEQUENCE
  Engineered IL-6 binding polypeptide
VDAKYAKEEQDAWREIHLLPNLTINQIVAFIQKLFDDPSQSSELLSEAKKLNDSQAPK

SEQ ID NO: 208 - protein, 58 aa, ARTIFICIAL SEQUENCE
  Engineered IL-6 binding polypeptide
VDAKYAKEEREAWYEIHSLPNLTVTQIAAFISKLFDDPSQSSELLSEAKKLNDSQAPK

SEQ ID NO: 209 - protein, 58 aa, ARTIFICIAL SEQUENCE
  Engineered IL-6 binding polypeptide
VDAKYAKEEATAWYEIHILPNLTVDQMAAFISKLFDDPSQSSELLSEAKKLNDSQAPK

SEQ ID NO: 210 - protein, 58 aa, ARTIFICIAL SEQUENCE
  Engineered IL-6 binding polypeptide
VDAKYAKEERDAWYEIHKLPNLTANQMAAFISKLFDDPSQSSELLSEAKKLNDSQAPK

SEQ ID NO: 211 - protein, 58 aa, ARTIFICIAL SEQUENCE
  Engineered IL-6 binding polypeptide
VDAKYAKEERDAWFEIHALPNLTVHQMTAFIIKLFDDPSQSSELLSEAKKLNDSQAPK

SEQ ID NO: 212 - protein, 58 aa, ARTIFICIAL SEQUENCE
  Engineered IL-6 binding polypeptide
VDAKYAKEEREAWSEIHKLPNLTVDQMAAFISKLFDDPSQSSELLSEAKKLNDSQAPK

SEQ ID NO: 213 - protein, 58 aa, ARTIFICIAL SEQUENCE
  Engineered IL-6 binding polypeptide
VDAKYAKEEREAWFEIHLLPNLTVDQMAAFISKLFDDPSQSSELLSEAKKLNDSQAPK

SEQ ID NO: 214 - protein, 58 aa, ARTIFICIAL SEQUENCE
  Engineered IL-6 binding polypeptide
VDAKYAKEERKAWYEIHLLPNLTVQQMAAFISKLFDDPSQSSELLSEAKKLNDSQAPK

SEQ ID NO: 215 - protein, 58 aa, ARTIFICIAL SEQUENCE
  Engineered IL-6 binding polypeptide
VDAKYAKEEREAWYEIHSLPNLTVNQVAAFIQKLFDDPSQSSELLSEAKKLNDSQAPK

SEQ ID NO: 216 - protein, 58 aa, ARTIFICIAL SEQUENCE
  Engineered IL-6 binding polypeptide
VDAKYAKEERHAWREIHLLPNLTTEQRVAFIIKLFDDPSQSSELLSEAKKLNDSQAPK

SEQ ID NO: 217 - protein, 58 aa, ARTIFICIAL SEQUENCE
  Engineered IL-6 binding polypeptide
VDAKYAKEEREAWTEIHSLPNLTVDQVTAFISKLFDDPSQSSELLSEAKKLNDSQAPK

SEQ ID NO: 218 - protein, 58 aa, ARTIFICIAL SEQUENCE
  Engineered IL-6 binding polypeptide
VDAKYAKEERDAWWEIHLLPNLTVNQISAFISKLFDDPSQSSELLSEAKKLNDSQAPK

SEQ ID NO: 219 - protein, 58 aa, ARTIFICIAL SEQUENCE
  Engineered IL-6 binding polypeptide
VDAKYAKEEHHAWREIHLLPNLTVEQMAAFISKLFDDPSQSSELLSEAKKLNDSQAPK

SEQ ID NO: 220 - protein, 58 aa, ARTIFICIAL SEQUENCE
  Engineered IL-6 binding polypeptide
VDAKYAKEEQQAWHEIHLLPNLTVDQMAAFISKLFDDPSQSSELLSEAKKLNDSQAPK

SEQ ID NO: 221 - protein, 58 aa, ARTIFICIAL SEQUENCE
  Engineered IL-6 binding polypeptide
VDAKYAKEEAQAWHEIHLLPNLTIHQMSAFISKLFDDPSQSSELLSEAKKLNDSQAPK

SEQ ID NO: 222 - protein, 58 aa, ARTIFICIAL SEQUENCE
  Engineered IL-6 binding polypeptide
VDAKYAKEEAKAWWEIHVLPNLTIDQIAAFISKLFDDPSQSSELLSEAKKLNDSQAPK

SEQ ID NO: 223 - protein, 58 aa, ARTIFICIAL SEQUENCE
  Engineered IL-6 binding polypeptide
VDAKYAKEEAQAWHEIHTLPNLTTEQMAAFISKLFDDPSQSSELLSEAKKLNDSQAPK

SEQ ID NO: 224 - protein, 58 aa, ARTIFICIAL SEQUENCE
  Engineered IL-6 binding polypeptide
VDAKYAKEERDAWSEIHSLPNLTISQMAAFISKLFDDPSQSSELLSEAKKLNDSQAPK

SEQ ID NO: 225 - protein, 58 aa, ARTIFICIAL SEQUENCE
  Engineered IL-6 binding polypeptide
VDAKYAKEERKAWHEIHILPNLTAEQLAAFISKLFDDPSQSSELLSEAKKLNDSQAPK

SEQ ID NO: 226 - protein, 58 aa, ARTIFICIAL SEQUENCE
  Engineered IL-6 binding polypeptide
VDAKYAKEEADAWREIHVLPNLTTQQITAFIQKLFDDPSQSSELLSEAKKLNDSQAPK

SEQ ID NO: 227 - protein, 58 aa, ARTIFICIAL SEQUENCE
  Engineered IL-6 binding polypeptide
VDAKYAKEERSAWTEIHMLPNLTVQQRAAFISKLFDDPSQSSELLSEAKKLNDSQAPK

SEQ ID NO: 228 - protein, 58 aa, ARTIFICIAL SEQUENCE
  Engineered IL-6 binding polypeptide
VDAKYAKEEREAWYEIHLLPNLTIDQMSAFISKLFDDPSQSSELLSEAKKLNDSQAPK

SEQ ID NO: 229 - protein, 58 aa, ARTIFICIAL SEQUENCE
  Engineered IL-6 binding polypeptide
VDAKYAKEEREAWYEIHLLPNLTVEQIVAFISKLFDDPSQSSELLSEAKKLNDSQAPK

SEQ ID NO: 230 - protein, 58 aa, ARTIFICIAL SEQUENCE
  Engineered IL-6 binding polypeptide
VDAKYAKEERKAWFEIHSLPNLTVNQMAAFIQKLFDDPSQSSELLSEAKKLNDSQAPK

SEQ ID NO: 231 - protein, 58 aa, ARTIFICIAL SEQUENCE
  Engineered IL-6 binding polypeptide
VDAKYAKEEADAWFEIHLLPNLTIDQVSAFISKLFDDPSQSSELLSEAKKLNDSQAPK

SEQ ID NO: 232 - protein, 58 aa, ARTIFICIAL SEQUENCE
  Engineered IL-6 binding polypeptide
VDAKYAKEERDAWFEIHLLPNLTIEQMAAFISKLFDDPSQSSELLSEAKKLNDSQAPK

SEQ ID NO: 233 - protein, 58 aa, ARTIFICIAL SEQUENCE
  Engineered IL-6 binding polypeptide
VDAKYAKEEADAWREIHTLPNLTVDQMSAFISKLFDDPSQSSELLSEAKKLNDSQAPK

SEQ ID NO: 234 - protein, 58 aa, ARTIFICIAL SEQUENCE
  Engineered IL-6 binding polypeptide
VDAKYAKEERVAWYEIHMLPNLTINQMAAFISKLFDDPSQSSELLSEAKKLNDSQAPK

SEQ ID NO: 235 - protein, 58 aa, ARTIFICIAL SEQUENCE
  Engineered IL-6 binding polypeptide
VDAKYAKEERDAWYEIHLLPNLTVNQMAAFISKLFDDPSQSSELLSEAKKLNDSQAPK

SEQ ID NO: 236 - protein, 58 aa, ARTIFICIAL SEQUENCE
  Engineered IL-6 binding polypeptide
VDAKYAKEERDAWWEIHSLPNLTTQQMAAFIIKLYDDPSQSSELLSEAKKLNDSQAPK

SEQ ID NO: 237 - protein, 58 aa, ARTIFICIAL SEQUENCE
  Engineered IL-6 binding polypeptide
VDAKYAKEEARAWHEIHTLPNLTIEQMAAFISKLFDDPSQSSELLSEAKKLNDSQAPK

SEQ ID NO: 238 - protein, 58 aa, ARTIFICIAL SEQUENCE
  Engineered IL-6 binding polypeptide
VDAKYAKEERAAWYEIHLLPNLTVEQTAAFISKLFDDPSQSSELLSEAKKLNDSQAPK

SEQ ID NO: 239 - protein, 58 aa, ARTIFICIAL SEQUENCE
  Engineered IL-6 binding polypeptide
VDAKYAKEEREAWYEIHLLPNLTVEQIAAFISKLFDDPSQSSELLSEAKKLNDSQAPK

SEQ ID NO: 240 - protein, 58 aa, ARTIFICIAL SEQUENCE
  Engineered IL-6 binding polypeptide
VDAKYAKEEQHAWREIHLLPNLTTDQMAAFIQKLFDDPSQSSELLSEAKKLNDSQAPK

SEQ ID NO: 241 - protein, 58 aa, ARTIFICIAL SEQUENCE
  Engineered IL-6 binding polypeptide
VDAKYAKEEASAWWEIHLLPNLTTTQRAAFISKLFDDPSQSSELLSEAKKLNDSQAPK

SEQ ID NO: 242 - protein, 58 aa, ARTIFICIAL SEQUENCE
  Engineered IL-6 binding polypeptide
VDAKYAKEEATAWYEIHALPNLTVDQMVAFISKLFDDPSQSSELLSEAKKLNDSQAPK

SEQ ID NO: 243 - protein, 58 aa, ARTIFICIAL SEQUENCE
  Engineered IL-6 binding polypeptide
VDAKYAKEEHKAWTEIHLLPNLTVSQISAFISKLFDDPSQSSELLSEAKKLNDSQAPK

SEQ ID NO: 244 - protein, 58 aa, ARTIFICIAL SEQUENCE
  Engineered IL-6 binding polypeptide
VDAKYAKEEQAAWREIHTLPNLTIEQIAAFISKLFDDPSQSSELLSEAKKLNDSQAPK

SEQ ID NO: 245 - protein, 58 aa, ARTIFICIAL SEQUENCE
  Engineered IL-6 binding polypeptide
VDAKYAKEERAAWFEIHTLPNLTVNQMAAFISKLFDDPSQSSELLSEAKKLNDSQAPK

SEQ ID NO: 246 - protein, 58 aa, ARTIFICIAL SEQUENCE
  Engineered IL-6 binding polypeptide
VDAKYAKEEAAAWFEIHALPNLTVNQMAAFISKLFDDPSQSSELLSEAKKLNDSQAPK

SEQ ID NO: 247 - protein, 58 aa, ARTIFICIAL SEQUENCE
  Engineered IL-6 binding polypeptide
VDAKYAKEEAKAWFEIHKLPNLTAEQISAFIIKLFDDPSQSSELLSEAKKLNDSQAPK

SEQ ID NO: 248 - protein, 58 aa, ARTIFICIAL SEQUENCE
  Engineered IL-6 binding polypeptide
VDAKYAKEEREAWYEIHLLPNLTVQQIVAFIIKLFDDPSQSSELLSEAKKLNDSQAPK

SEQ ID NO: 249 - protein, 58 aa, ARTIFICIAL SEQUENCE
  Engineered IL-6 binding polypeptide
VDAKYAKEEQQAWYEIHLLPNLTIEQMAAFISKLFDDPSQSSELLSEAKKLNDSQAPK

SEQ ID NO: 250 - protein, 58 aa, ARTIFICIAL SEQUENCE
  Engineered IL-6 binding polypeptide
VDAKYAKEERDAWFEIHSLPNLTVDQMVAFISKLFDDPSQSSELLSEAKKLNDSQAPK

SEQ ID NO: 251 - protein, 58 aa, ARTIFICIAL SEQUENCE
  Engineered IL-6 binding polypeptide
VDAKYAKEEAEAWFEIHTLPNLTVQQMAAFISKLFDDPSQSSELLSEAKKLNDSQAPK

SEQ ID NO: 252 - protein, 58 aa, ARTIFICIAL SEQUENCE
  Engineered IL-6 binding polypeptide
VDAKYAKEEQKAWHEIHKLPNLTVDQTTAFISKLFDDPSQSSELLSEAKKLNDSQAPK

SEQ ID NO: 253 - protein, 58 aa, ARTIFICIAL SEQUENCE
  Engineered IL-6 binding polypeptide
VDAKYAKEEREAWYEIHLLPNLTIEQMVAFISKLFDDPSQSSELLSEAKKLNDSQAPK

SEQ ID NO: 254 - protein, 58 aa, ARTIFICIAL SEQUENCE
  Engineered IL-6 binding polypeptide
VDAKYAKEEAEAWFEIHTLPNLTVDQMAAFIVKLYDDPSQSSELLSEAKKLNDSQAPK

SEQ ID NO: 255 - protein, 58 aa, ARTIFICIAL SEQUENCE
  Engineered IL-6 binding polypeptide
VDAKYAKEEAEAWFEIHTLPNLTVTQIAAFISKLFDDPSQSSELLSEAKKLNDSQAPK

SEQ ID NO: 256 - protein, 58 aa, ARTIFICIAL SEQUENCE
  Engineered IL-6 binding polypeptide
VDAKYAKEERQAWYEIHALPNLTADQMAAFIQKLFDDPSQSSELLSEAKKLNDSQAPK

SEQ ID NO: 257 - protein, 58 aa, ARTIFICIAL SEQUENCE
  Engineered IL-6 binding polypeptide
VDAKYAKEEQSAWYEIHALPNLTVQQMEAFISKLFDDPSQSSELLSEAKKLNDSQAPK

SEQ ID NO: 258 - protein, 58 aa, ARTIFICIAL SEQUENCE
  Engineered IL-6 binding polypeptide
VDAKYAKEEADAWLEIHLLPNLTVEQMAAFISKLFDDPSQSSELLSEAKKLNDSQAPK

SEQ ID NO: 259 - protein, 58 aa, ARTIFICIAL SEQUENCE
  Engineered IL-6 binding polypeptide
VDAKYAKEEQQAWWEIHTLPNLTVDQRSAFIVKLYDDPSQSSELLSEAKKLNDSQAPK

SEQ ID NO: 260 - protein, 58 aa, ARTIFICIAL SEQUENCE
  Engineered IL-6 binding polypeptide
VDAKYAKEERKAWHEIHILPNLTVNQISAFIQKLFDDPSQSSELLSEAKKLNDSQAPK

SEQ ID NO: 261 - protein, 58 aa, ARTIFICIAL SEQUENCE
  Engineered IL-6 binding polypeptide
VDAKYAKEEAHAWWEIHKLPNLTTDQTAAFISKLFDDPSQSSELLSEAKKLNDSQAPK

SEQ ID NO: 262 - protein, 58 aa, ARTIFICIAL SEQUENCE
  Engineered IL-6 binding polypeptide
VDAKYAKEERDAWYEIHILPNLTVTQMAAFISKLFDDPSQSSELLSEAKKLNDSQAPK

SEQ ID NO: 263 - protein, 58 aa, ARTIFICIAL SEQUENCE
  Engineered IL-6 binding polypeptide
VDAKYAKEEAQAWREIHTLPNLTAQQMAAFISKLFDDPSQSSELLSEAKKLNDSQAPK

SEQ ID NO: 264 - protein, 58 aa, ARTIFICIAL SEQUENCE
  Engineered IL-6 binding polypeptide
VDAKYAKEERRAWHEIHVLPNLTVEQMAAFISKLFDDPSQSSELLSEAKKLNDSQAPK

SEQ ID NO: 265 - protein, 58 aa, ARTIFICIAL SEQUENCE
  Engineered IL-6 binding polypeptide
VDAKYAKEEREAWSEIHLLPNLTVTQMAAFISKLFDDPSQSSELLSEAKKLNDSQAPK

SEQ ID NO: 266 - protein, 58 aa, ARTIFICIAL SEQUENCE
  Engineered IL-6 binding polypeptide
VDAKYAKEERKAWYEIHLLPNLTVSQMAAFISKLFDDPSQSSELLSEAKKLNDSQAPK

SEQ ID NO: 267 - protein, 58 aa, ARTIFICIAL SEQUENCE
  Engineered IL-6 binding polypeptide
VDAKYAKEEARAWYEIHLLPNLTVTQMAAFISKLFDDPSQSSELLSEAKKLNDSQAPK

SEQ ID NO: 268 - protein, 58 aa, ARTIFICIAL SEQUENCE
  Engineered IL-6 binding polypeptide
VDAKYAKEEHEAWTEIHKLPNLTTEQMAAFISKLFDDPSQSSELLSEAKKLNDSQAPK

SEQ ID NO: 269 - protein, 58 aa, ARTIFICIAL SEQUENCE
  Engineered IL-6 binding polypeptide
VDAKYAKEERDAWFEIHSLPNLTVQQMAAFISKLFDDPSQSSELLSEAKKLNDSQAPK

SEQ ID NO: 270 - protein, 58 aa, ARTIFICIAL SEQUENCE
  Engineered IL-6 binding polypeptide
VDAKYAKEEQSAWHEIHLLPNLTVDQIAAFISKLFDDPSQSSELLSEAKKLNDSQAPK

SEQ ID NO: 271 - protein, 58 aa, ARTIFICIAL SEQUENCE
  Engineered IL-6 binding polypeptide
VDAKYAKEEQAAWYEIHALPNLTVDQMTAFISKLFDDPSQSSELLSEAKKLNDSQAPK

SEQ ID NO: 272 - protein, 58 aa, ARTIFICIAL SEQUENCE
  Engineered IL-6 binding polypeptide
VDAKYAKEEAAAWREIHLLPNLTTQQMAAFISKLFDDPSQSSELLSEAKKLNDSQAPK

SEQ ID NO: 273 - protein, 58 aa, ARTIFICIAL SEQUENCE
  Engineered IL-6 binding polypeptide
VDAKYAKEEREAWYEIHILPNLTVEQMAAFISKLFDDPSQSSELLSEAKKLNDSQAPK

SEQ ID NO: 274 - protein, 58 aa, ARTIFICIAL SEQUENCE
  Engineered IL-6 binding polypeptide
VDAKYAKEERKAWYEIHTLPNLTVDQMAAFISKLFDDPSQSSELLSEAKKLNDSQAPK

SEQ ID NO: 275 - protein, 58 aa, ARTIFICIAL SEQUENCE
  Engineered IL-6 binding polypeptide
VDAKYAKEEAKAWREIHLLPNLTVEQMAAFISKLFDDPSQSSELLSEAKKLNDSQAPK

SEQ ID NO: 276 - protein, 58 aa, ARTIFICIAL SEQUENCE
  Engineered IL-6 binding polypeptide
VDAKYAKEEAQAWSEIHMLPNLTVTQIAAFISKLFDDPSQSSELLSEAKKLNDSQAPK

SEQ ID NO: 277 - protein, 58 aa, ARTIFICIAL SEQUENCE
  Engineered IL-6 binding polypeptide
VDAKYAKEEAHAWHEIHILPNLTVDQMSAFISKLFDDPSQSSELLSEAKKLNDSQAPK

SEQ ID NO: 278 - protein, 58 aa, ARTIFICIAL SEQUENCE
  Engineered IL-6 binding polypeptide
VDAKYAKEEREAWFEIHLLPNLTVEQIAAFISKLFDDPSQSSELLSEAKKLNDSQAPK

SEQ ID NO: 279 - protein, 58 aa, ARTIFICIAL SEQUENCE
  Engineered IL-6 binding polypeptide
VDAKYAKEERKAWWEIHLLPNLTIEQMAAFISKLFDDPSQSSELLSEAKKLNDSQAPK

SEQ ID NO: 280 - protein, 58 aa, ARTIFICIAL SEQUENCE
  Engineered IL-6 binding polypeptide
VDAKYAKEERDAWYEIHTLPNLTVEQMVAFISKLFDDPSQSSELLSEAKKLNDSQAPK

SEQ ID NO: 281 - protein, 58 aa, ARTIFICIAL SEQUENCE
  Engineered IL-6 binding polypeptide
VDAKYAKEERKAWYEIHALPNLTVSQMAAFIIKLYDDPSQSSELLSEAKKLNDSQAPK

SEQ ID NO: 282 - protein, 58 aa, ARTIFICIAL SEQUENCE
  Engineered IL-6 binding polypeptide
VDAKYAKEEHKAWWEIHALPNLTISQITAFISKLFDDPSQSSELLSEAKKLNDSQAPK

SEQ ID NO: 283 - protein, 58 aa, ARTIFICIAL SEQUENCE
  Engineered IL-6 binding polypeptide
VDAKYAKEEAQAWYEIHLLPNLTIEQMAAFISKLFDDPSQSSELLSEAKKLNDSQAPK

SEQ ID NO: 284 - protein, 58 aa, ARTIFICIAL SEQUENCE
  Engineered IL-6 binding polypeptide
VDAKYAKEEQDAWWEIHALPNLTIDQMAAFISKLFDDPSQSSELLSEAKKLNDSQAPK

SEQ ID NO: 285 - protein, 58 aa, ARTIFICIAL SEQUENCE
  Engineered IL-6 binding polypeptide
VDAKYAKEEHDAWWEIHILPNLTVEQIAAFISKLFDDPSQSSELLSEAKKLNDSQAPK

SEQ ID NO: 286 - protein, 58 aa, ARTIFICIAL SEQUENCE
  Engineered IL-6 binding polypeptide
VDAKYAKEEARAWLEIHTLPNLTITQRAAFISKLFDDPSQSSELLSEAKKLNDSQAPK

SEQ ID NO: 287 - protein, 58 aa, ARTIFICIAL SEQUENCE
  Engineered IL-6 binding polypeptide
VDAKYAKEERKAWHEIHILPNLTINQRAAFISKLFDDPSQSSELLSEAKKLNDSQAPK

SEQ ID NO: 288 - protein, 58 aa, ARTIFICIAL SEQUENCE
  Engineered IL-6 binding polypeptide
VDAKYAKEEREAWYEIHMLPNLTVTQMAAFISKLFDDPSQSSELLSEAKKLNDSQAPK

SEQ ID NO: 289 - protein, 58 aa, ARTIFICIAL SEQUENCE
  Engineered IL-6 binding polypeptide
VDAKYAKEERDAWFEIHILPNLTIHQMAAFISKLFDDPSQSSELLSEAKKLNDSQAPK

SEQ ID NO: 290 - protein, 58 aa, ARTIFICIAL SEQUENCE
  Engineered IL-6 binding polypeptide
VDAKYAKEEHDAWYEIHTLPNLTVDQMVAFISKLFDDPSQSSELLSEAKKLNDSQAPK

SEQ ID NO: 291 - protein, 58 aa, ARTIFICIAL SEQUENCE
  Engineered IL-6 binding polypeptide
VDAKYAKEEAQAWYEIHTLPNLTVDQMAAFISKLFDDPSQSSELLSEAKKLNDSQAPK

SEQ ID NO: 292 - protein, 58 aa, ARTIFICIAL SEQUENCE
  Engineered IL-6 binding polypeptide
VDAKYAKEERVAWWEIHSLPNLTIDQRSAFISKLFDDPSQSSELLSEAKKLNDSQAPK

SEQ ID NO: 293 - protein, 58 aa, ARTIFICIAL SEQUENCE
  Engineered IL-6 binding polypeptide
VDAKYAKEEHEAWTEIHLLPNLTVSQIAAFISKLFDDPSQSSELLSEAKKLNDSQAPK

SEQ ID NO: 294 - protein, 58 aa, ARTIFICIAL SEQUENCE
  Engineered IL-6 binding polypeptide
VDAKYAKEEAQAWREIHLLPNLTVDQIAAFISKLFDDPSQSSELLSEAKKLNDSQAPK

SEQ ID NO: 295 - protein, 58 aa, ARTIFICIAL SEQUENCE
  Engineered IL-6 binding polypeptide
VDAKYAKEERDAWHEIHVLPNLTAEQMSAFISKLFDDPSQSSELLSEAKKLNDSQAPK

SEQ ID NO: 296 - protein, 58 aa, ARTIFICIAL SEQUENCE
  Engineered IL-6 binding polypeptide
VDAKYAKEEATAWFEIHTLPNLTVDQMAAFIIKLFDDPSQSSELLSEAKKLNDSQAPK

SEQ ID NO: 297 - protein, 58 aa, ARTIFICIAL SEQUENCE
  Engineered IL-6 binding polypeptide
VDAKYAKEERHAWFEIHTLPNLTVTQMAAFISKLFDDPSQSSELLSEAKKLNDSQAPK

SEQ ID NO: 298 - protein, 58 aa, ARTIFICIAL SEQUENCE
  Engineered IL-6 binding polypeptide
VDAKYAKEEREAWWEIHALPNLTTNQVAAFISKLFDDPSQSSELLSEAKKLNDSQAPK

SEQ ID NO: 299 - protein, 58 aa, ARTIFICIAL SEQUENCE
  Engineered IL-6 binding polypeptide
VDAKYAKEERRAWWEIHLLPNLTIQQIAAFISKLFDDPSQSSELLSEAKKLNDSQAPK

SEQ ID NO: 300 - protein, 58 aa, ARTIFICIAL SEQUENCE
  Engineered IL-6 binding polypeptide
VDAKYAKEEAHAWFEIHILPNLTIDQMAAFISKLFDDPSQSSELLSEAKKLNDSQAPK

SEQ ID NO: 301 - protein, 58 aa, ARTIFICIAL SEQUENCE
  Engineered IL-6 binding polypeptide
VDAKYAKEEARAWREIHLLPNLTVEQMAAFISKLFDDPSQSSELLSEAKKLNDSQAPK

SEQ ID NO: 302 - protein, 58 aa, ARTIFICIAL SEQUENCE
  Engineered IL-6 binding polypeptide
VDAKYAKEERRAWYEIHTLPNLTVEQLSAFISKLFDDPSQSSELLSEAKKLNDSQAPK

SEQ ID NO: 303 - protein, 58 aa, ARTIFICIAL SEQUENCE
  Engineered IL-6 binding polypeptide
VDAKYAKEEAHAWHEIHVLPNLTVEQIAAFISKLFDDPSQSSELLSEAKKLNDSQAPK

SEQ ID NO: 304 - protein, 58 aa, ARTIFICIAL SEQUENCE
  Engineered IL-6 binding polypeptide
VDAKYAKEEREAWFEIHTLPNLTVEQMAAFISKLFDDPSQSSELLSEAKKLNDSQAPK

SEQ ID NO: 305 - protein, 58 aa, ARTIFICIAL SEQUENCE
  Engineered IL-6 binding polypeptide
VDAKYAKEERDAWWEIHSLPNLTIDQMAAFISKLFDDPSQSSELLSEAKKLNDSQAPK

SEQ ID NO: 306 - protein, 58 aa, ARTIFICIAL SEQUENCE
  Engineered IL-6 binding polypeptide
VDAKYAKEEARAWHEIHILPNLTIQQITAFIQKLFDDPSQSSELLSEAKKLNDSQAPK

SEQ ID NO: 307 - protein, 58 aa, ARTIFICIAL SEQUENCE
  Engineered IL-6 binding polypeptide
VDAKYAKEEQKAWHEIHLLPNLTINQIVAFISKLFDDPSQSSELLSEAKKLNDSQAPK

SEQ ID NO: 308 - protein, 58 aa, ARTIFICIAL SEQUENCE
  Engineered IL-6 binding polypeptide
VDAKYAKEEREAWYEIHILPNLTVNQVAAFISKLFDDPSQSSELLSEAKKLNDSQAPK

SEQ ID NO: 309 - protein, 58 aa, ARTIFICIAL SEQUENCE
  Engineered IL-6 binding polypeptide
VDAKYAKEERVAWYEIHALPNLTVTQMAAFISKLFDDPSQSSELLSEAKKLNDSQAPK

SEQ ID NO: 310 - protein, 58 aa, ARTIFICIAL SEQUENCE
  Engineered IL-6 binding polypeptide
VDAKYAKEERVAWLEIHALPNLTVDQMAAFIIKLFDDPSQSSELLSEAKKLNDSQAPK

SEQ ID NO: 311 - protein, 58 aa, ARTIFICIAL SEQUENCE
  Engineered IL-6 binding polypeptide
VDAKYAKEERDAWFEIHMLPNLTVNQMAAFIIKLFDDPSQSSELLSEAKKLNDSQAPK

SEQ ID NO: 312 - protein, 58 aa, ARTIFICIAL SEQUENCE
  Engineered IL-6 binding polypeptide
VDAKYAKEEAVAWFEIHTLPNLTVEQMAAFIVKLFDDPSQSSELLSEAKKLNDSQAPK

SEQ ID NO: 313 - protein, 58 aa, ARTIFICIAL SEQUENCE
  Engineered IL-6 binding polypeptide
VDAKYAKEEQDAWSEIHLLPNLTVNQMAAFISKLFDDPSQSSELLSEAKKLNDSQAPK

SEQ ID NO: 314 - protein, 58 aa, ARTIFICIAL SEQUENCE
  Engineered IL-6 binding polypeptide
VDAKYAKEERDAWWEIHALPNLTVDQMVAFISKLFDDPSQSSELLSEAKKLNDSQAPK

SEQ ID NO: 315 - protein, 58 aa, ARTIFICIAL SEQUENCE
  Engineered IL-6 binding polypeptide
VDAKYAKEEAHAWHEIHVLPNLTVHQVAAFISKLFDDPSQSSELLSEAKKLNDSQAPK

SEQ ID NO: 316 - protein, 58 aa, ARTIFICIAL SEQUENCE
  Engineered IL-6 binding polypeptide
VDAKYAKEEREAWYEIHLLPNLTAEQMAAFISKLFDDPSQSSELLSEAKKLNDSQAPK

SEQ ID NO: 317 - protein, 58 aa, ARTIFICIAL SEQUENCE
  Engineered IL-6 binding polypeptide
VDAKYAKEEQEAWYEIHILPNLTISQMAAFISKLFDDPSQSSELLSEAKKLNDSQAPK

SEQ ID NO: 318 - protein, 58 aa, ARTIFICIAL SEQUENCE
  Engineered IL-6 binding polypeptide
VDAKYAKEERDAWYEIHTLPNLTVEQMAAFISKLFDDPSQSSELLSEAKKLNDSQAPK

SEQ ID NO: 319 - protein, 58 aa, ARTIFICIAL SEQUENCE
  Engineered IL-6 binding polypeptide
VDAKYAKEERQAWTEIHLLPNLTVTQMAAFISKLFDDPSQSSELLSEAKKLNDSQAPK

SEQ ID NO: 320 - protein, 58 aa, ARTIFICIAL SEQUENCE
  Engineered IL-6 binding polypeptide
VDAKYAKEERDAWLEIHLLPNLTVEQMAAFISKLFDDPSQSSELLSEAKKLNDSQAPK

SEQ ID NO: 321 - protein, 58 aa, ARTIFICIAL SEQUENCE
  Engineered IL-6 binding polypeptide
VDAKYAKEEQRAWTEIHTLPNLTVDQMAAFISKLFDDPSQSSELLSEAKKLNDSQAPK

SEQ ID NO: 322 - protein, 58 aa, ARTIFICIAL SEQUENCE
  Engineered IL-6 binding polypeptide
VDAKYAKEERKAWWEIHLLPNLTVDQITAFISKLFDDPSQSSELLSEAKKLNDSQAPK

SEQ ID NO: 323 - protein, 58 aa, ARTIFICIAL SEQUENCE
  Engineered IL-6 binding polypeptide
VDAKYAKEEARAWHEIHILPNLTVDQIAAFISKLFDDPSQSSELLSEAKKLNDSQAPK

SEQ ID NO: 324 - protein, 58 aa, ARTIFICIAL SEQUENCE
  Engineered IL-6 binding polypeptide
VDAKYAKEEREAWHEIHILPNLTVTQMAAFISKLFDDPSQSSELLSEAKKLNDSQAPK

SEQ ID NO: 325 - protein, 58 aa, ARTIFICIAL SEQUENCE
  Engineered IL-6 binding polypeptide
VDAKYAKEEQDAWWEIHKLPNLTTHQVAAFISKLFDDPSQSSELLSEAKKLNDSQAPK

SEQ ID NO: 326 - protein, 58 aa, ARTIFICIAL SEQUENCE
  Engineered IL-6 binding polypeptide
VDAKYAKEERRAWFEIHALPNLTTEQMAAFIWKLFDDPSQSSELLSEAKKLNDSQAPK

SEQ ID NO: 327 - protein, 58 aa, ARTIFICIAL SEQUENCE
  Engineered IL-6 binding polypeptide
VDAKYAKEEAAAWFEIHTLPNLTIEQMSAFISKLFDDPSQSSELLSEAKKLNDSQAPK

SEQ ID NO: 328 - protein, 58 aa, ARTIFICIAL SEQUENCE
  Engineered IL-6 binding polypeptide
VDAKYAKEEREAWFEIHLLPNLTIEQMAAFISKLFDDPSQSSELLSEAKKLNDSQAPK

SEQ ID NO: 329 - protein, 58 aa, ARTIFICIAL SEQUENCE
  Engineered IL-6 binding polypeptide
VDAKYAKEERKAWYEIHTLPNLTVNQMAAFISKLFDDPSQSSELLSEAKKLNDSQAPK

SEQ ID NO: 330 - protein, 58 aa, ARTIFICIAL SEQUENCE
  Engineered IL-6 binding polypeptide
VDAKYAKEERQAWLEIHLLPNLTIEQMAAFISKLFDDPSQSSELLSEAKKLNDSQAPK

SEQ ID NO: 331 - protein, 58 aa, ARTIFICIAL SEQUENCE
  Engineered IL-6 binding polypeptide
VDAKYAKEEHHAWLEIHTLPNLTVDQMAAFISKLFDDPSQSSELLSEAKKLNDSQAPK

SEQ ID NO: 332 - protein, 58 aa, ARTIFICIAL SEQUENCE
  Engineered IL-6 binding polypeptide
VDAKYAKEEQQAWWEIHKLPNLTVEQMTAFIIKLYDDPSQSSELLSEAKKLNDSQAPK

SEQ ID NO: 333 - protein, 58 aa, ARTIFICIAL SEQUENCE
  Engineered IL-6 binding polypeptide
VDAKYAKEERKAWFEIHALPNLTVTQVAAFISKLFDDPSQSSELLSEAKKLNDSQAPK

SEQ ID NO: 334 - protein, 58 aa, ARTIFICIAL SEQUENCE
  Engineered IL-6 binding polypeptide
VDAKYAKEEHRAWTEIHKLPNLTTQQMAAFISKLFDDPSQSSELLSEAKKLNDSQAPK

SEQ ID NO: 335 - protein, 58 aa, ARTIFICIAL SEQUENCE
  Engineered IL-6 binding polypeptide
VDAKYAKEEAQAWHEIHILPNLTVDQMAAFISKLFDDPSQSSELLSEAKKLNDSQAPK

SEQ ID NO: 336 - protein, 58 aa, ARTIFICIAL SEQUENCE
  Engineered IL-6 binding polypeptide
VDAKYAKEEQKAWFEIHLLPNLTVEQIAAFIQKLFDDPSQSSELLSEAKKLNDSQAPK

SEQ ID NO: 337 - protein, 58 aa, ARTIFICIAL SEQUENCE
  Engineered IL-6 binding polypeptide
VDAKYAKEERHAWYEIHLLPNLTVRQMAAFISKLFDDPSQSSELLSEAKKLNDSQAPK

SEQ ID NO: 338 - protein, 58 aa, ARTIFICIAL SEQUENCE
  Engineered IL-6 binding polypeptide
VDAKYAKEERDAWYEIHLLPNLTVNQIAAFISKLFDDPSQSSELLSEAKKLNDSQAPK

SEQ ID NO: 339 - protein, 58 aa, ARTIFICIAL SEQUENCE
  Engineered IL-6 binding polypeptide
VDAKYAKEEAHAWWEIHALPNLTVDQMAAFISKLFDDPSQSSELLSEAKKLNDSQAPK

SEQ ID NO: 340 - protein, 58 aa, ARTIFICIAL SEQUENCE
  Engineered IL-6 binding polypeptide
VDAKYAKEEADAWFEIHVLPNLTIQQIAAFISKLFDDPSQSSELLSEAKKLNDSQAPK

SEQ ID NO: 341 - protein, 58 aa, ARTIFICIAL SEQUENCE
  Engineered IL-6 binding polypeptide
VDAKYAKEERRAWFEIHILPNLTINQMAAFISKLFDDPSQSSELLSEAKKLNDSQAPK

SEQ ID NO: 342 - protein, 58 aa, ARTIFICIAL SEQUENCE
  Engineered IL-6 binding polypeptide
VDAKYAKEERKAWYEIHVLPNLTVRQMAAFIQKLFDDPSQSSELLSEAKKLNDSQAPK

SEQ ID NO: 343 - protein, 58 aa, ARTIFICIAL SEQUENCE
  Engineered IL-6 binding polypeptide
VDAKYAKEERHAWHEIHILPNLTVDQISAFISKLFDDPSQSSELLSEAKKLNDSQAPK

SEQ ID NO: 344 - protein, 58 aa, ARTIFICIAL SEQUENCE
  Engineered IL-6 binding polypeptide
VDAKYAKEERKAWLEIHLLPNLTVEQMAAFISKLFDDPSQSSELLSEAKKLNDSQAPK

SEQ ID NO: 345 - protein, 58 aa, ARTIFICIAL SEQUENCE
  Engineered IL-6 binding polypeptide
VDAKYAKEEREAWWEIHKLPNLTVTQMAAFISKLFDDPSQSSELLSEAKKLNDSQAPK

SEQ ID NO: 346 - protein, 58 aa, ARTIFICIAL SEQUENCE
  Engineered IL-6 binding polypeptide
VDAKYAKEERHAWYEIHTLPNLTVNQMAAFISKLFDDPSQSSELLSEAKKLNDSQAPK

SEQ ID NO: 347 - protein, 58 aa, ARTIFICIAL SEQUENCE
  Engineered IL-6 binding polypeptide
VDAKYAKEERHAWYEIHVLPNLTVQQMAAFIQKLFDDPSQSSELLSEAKKLNDSQAPK

SEQ ID NO: 348 - protein, 58 aa, ARTIFICIAL SEQUENCE
  Engineered IL-6 binding polypeptide
VDAKYAKEERHAWWEIHALPNLTVEQIAAFIQKLFDDPSQSSELLSEAKKLNDSQAPK

SEQ ID NO: 349 - protein, 58 aa, ARTIFICIAL SEQUENCE
  Engineered IL-6 binding polypeptide
VDAKYAKEEAAAWHEIHILPNLTVSQIAAFISKLFDDPSQSSELLSEAKKLNDSQAPK

SEQ ID NO: 350 - protein, 58 aa, ARTIFICIAL SEQUENCE
  Engineered IL-6 binding polypeptide
VDAKYAKEEASAWTEIHLLPNLTIDQMAAFIQKLFDDPSQSSELLSEAKKLNDSQAPK

SEQ ID NO: 351 - protein, 58 aa, ARTIFICIAL SEQUENCE
  Engineered IL-6 binding polypeptide
VDAKYAKEEQSAWYEIHILPNLTVDQIAAFISKLFDDPSQSSELLSEAKKLNDSQAPK

SEQ ID NO: 352 - protein, 58 aa, ARTIFICIAL SEQUENCE
  Engineered IL-6 binding polypeptide
VDAKYAKEEADAWYEIHLLPNLTVNQMAAFISKLFDDPSQSSELLSEAKKLNDSQAPK

SEQ ID NO: 353 - protein, 58 aa, ARTIFICIAL SEQUENCE
  Engineered IL-6 binding polypeptide
VDAKYAKEEQRAWFEIHTLPNLTVNQMAAFISKLFDDPSQSSELLSEAKKLNDSQAPK

SEQ ID NO: 354 - protein, 58 aa, ARTIFICIAL SEQUENCE
  Engineered IL-6 binding polypeptide
VDAKYAKEEAHAWYEIHILPNLTVSQIAAFISKLFDDPSQSSELLSEAKKLNDSQAPK

SEQ ID NO: 355 - protein, 58 aa, ARTIFICIAL SEQUENCE
  Engineered IL-6 binding polypeptide
VDAKYAKEEAAAWREIHSLPNLTTEQMAAFIMKLFDDPSQSSELLSEAKKLNDSQAPK

SEQ ID NO: 356 - protein, 58 aa, ARTIFICIAL SEQUENCE
  Engineered IL-6 binding polypeptide
VDAKYAKEEHQAWTEIHLLPNLTVQQITAFISKLFDDPSQSSELLSEAKKLNDSQAPK

SEQ ID NO: 357 - protein, 58 aa, ARTIFICIAL SEQUENCE
  Engineered IL-6 binding polypeptide
VDAKYAKEERKAWYEIHSLPNLTVSQMAAFISKLFDDPSQSSELLSEAKKLNDSQAPK

SEQ ID NO: 358 - protein, 58 aa, ARTIFICIAL SEQUENCE
  Engineered IL-6 binding polypeptide
VDAKYAKEEAHAWREIHVLPNLTVDQMAAFISKLFDDPSQSSELLSEAKKLNDSQAPK

SEQ ID NO: 359 - protein, 58 aa, ARTIFICIAL SEQUENCE
  Engineered IL-6 binding polypeptide
VDAKYAKEEAKAWTEIHLLPNLTVHQIAAFISKLFDDPSQSSELLSEAKKLNDSQAPK

SEQ ID NO: 360 - protein, 58 aa, ARTIFICIAL SEQUENCE
  Engineered IL-6 binding polypeptide
VDAKYAKEEREAWFEIHKLPNLTVTQMAAFIIKLFDDPSQSSELLSEAKKLNDSQAPK

SEQ ID NO: 361 - protein, 58 aa, ARTIFICIAL SEQUENCE
  Engineered IL-6 binding polypeptide
VDAKYAKEEADAWYEIHILPNLTVSQMAAFISKLFDDPSQSSELLSEAKKLNDSQAPK

SEQ ID NO: 362 - protein, 58 aa, ARTIFICIAL SEQUENCE
  Engineered IL-6 binding polypeptide
VDAKYAKEEARAWYEIHILPNLTVNQMAAFITKLFDDPSQSSELLSEAKKLNDSQAPK

SEQ ID NO: 363 - protein, 58 aa, ARTIFICIAL SEQUENCE
  Engineered IL-6 binding polypeptide
VDAKYAKEEREAWFEIHLLPNLTITQMAAFISKLFDDPSQSSELLSEAKKLNDSQAPK

SEQ ID NO: 364 - protein, 58 aa, ARTIFICIAL SEQUENCE
  Engineered IL-6 binding polypeptide
VDAKYAKEERDAWYEIHLLPNLTVTQMSAFISKLFDDPSQSSELLSEAKKLNDSQAPK

SEQ ID NO: 365 - protein, 58 aa, ARTIFICIAL SEQUENCE
  Engineered IL-6 binding polypeptide
VDAKYAKEEHEAWLEIHALPNLTVEQMSAFIIKLYDDPSQSSELLSEAKKLNDSQAPK

SEQ ID NO: 366 - protein, 58 aa, ARTIFICIAL SEQUENCE
  Engineered IL-6 binding polypeptide
VDAKYAKEEREAWFEIHLLPNLTVHQMAAFISKLFDDPSQSSELLSEAKKLNDSQAPK

SEQ ID NO: 367 - protein, 58 aa, ARTIFICIAL SEQUENCE
  Engineered IL-6 binding polypeptide
VDAKYAKEEHQAWTEIHLLPNLTTEQMAAFIQKLFDDPSQSSELLSEAKKLNDSQAPK

SEQ ID NO: 368 - protein, 58 aa, ARTIFICIAL SEQUENCE
  Engineered IL-6 binding polypeptide
VDAKYAKEEARAWYEIHVLPNLTTDQRSAFISKLFDDPSQSSELLSEAKKLNDSQAPK

SEQ ID NO: 369 - protein, 58 aa, ARTIFICIAL SEQUENCE
  Engineered IL-6 binding polypeptide
VDAKYAKEERDAWFEIHTLPNLTVSQMAAFISKLFDDPSQSSELLSEAKKLNDSQAPK

SEQ ID NO: 370 - protein, 58 aa, ARTIFICIAL SEQUENCE
  Engineered IL-6 binding polypeptide
VDAKYAKEERQAWFEIHSLPNLTVTQMAAFISKLFDDPSQSSELLSEAKKLNDSQAPK

SEQ ID NO: 371 - protein, 58 aa, ARTIFICIAL SEQUENCE
  Engineered IL-6 binding polypeptide
VDAKYAKEERQAWWEIHALPNLTAEQVAAFISKLFDDPSQSSELLSEAKKLNDSQAPK

SEQ ID NO: 372 - protein, 58 aa, ARTIFICIAL SEQUENCE
  Engineered IL-6 binding polypeptide
VDAKYAKEEAKAWYEIHTLPNLTVDQISAFIIKLFDDPSQSSELLSEAKKLNDSQAPK

SEQ ID NO: 373 - protein, 58 aa, ARTIFICIAL SEQUENCE
  Engineered IL-6 binding polypeptide
VDAKYAKEEREAWWEIHLLPNLTVDQISAFISKLFDDPSQSSELLSEAKKLNDSQAPK

SEQ ID NO: 374 - protein, 58 aa, ARTIFICIAL SEQUENCE
  Engineered IL-6 binding polypeptide
VDAKYAKEEADAWTEIHSLPNLTVEQMAAFIWKLLDDPSQSSELLSEAKKLNDSQAPK

SEQ ID NO: 375 - protein, 58 aa, ARTIFICIAL SEQUENCE
  Engineered IL-6 binding polypeptide
VDAKYAKEERAAWWEIHTLPNLTTDQRSAFIIKLYDDPSQSSELLSEAKKLNDSQAPK

SEQ ID NO: 376 - protein, 58 aa, ARTIFICIAL SEQUENCE
  Engineered IL-6 binding polypeptide
VDAKYAKEEHRAWTEIHLLPNLTTDQMAAFIIKLFDDPSQSSELLSEAKKLNDSQAPK

SEQ ID NO: 377 - protein, 58 aa, ARTIFICIAL SEQUENCE
  Engineered IL-6 binding polypeptide
VDAKYAKEEADAWWEIHMLPNLTTEQRSAFISKLFDDPSQSSELLSEAKKLNDSQAPK

SEQ ID NO: 378 - protein, 58 aa, ARTIFICIAL SEQUENCE
  Engineered IL-6 binding polypeptide
VDAKYAKEEREAWWEIHKLPNLTVEQVAAFISKLFDDPSQSSELLSEAKKLNDSQAPK

SEQ ID NO: 379 - protein, 58 aa, ARTIFICIAL SEQUENCE
  Engineered IL-6 binding polypeptide
VDAKYAKEEAHAWWEIHALPNLTVHQMAAFISKLFDDPSQSSELLSEAKKLNDSQAPK

SEQ ID NO: 380 - protein, 58 aa, ARTIFICIAL SEQUENCE
  Engineered IL-6 binding polypeptide
VDAKYAKEEAQAWREIHVLPNLTVQQIAAFISKLFDDPSQSSELLSEAKKLNDSQAPK

SEQ ID NO: 381 - protein, 58 aa, ARTIFICIAL SEQUENCE
  Engineered IL-6 binding polypeptide
VDAKYAKEERHAWWEIHKLPNLTVEQVAAFISKLFDDPSQSSELLSEAKKLNDSQAPK

SEQ ID NO: 382 - protein, 58 aa, ARTIFICIAL SEQUENCE
  Engineered IL-6 binding polypeptide
VDAKYAKEEAQAWWEIHKLPNLTVEQLAAFISKLFDDPSQSSELLSEAKKLNDSQAPK

SEQ ID NO: 383 - protein, 58 aa, ARTIFICIAL SEQUENCE
  Engineered IL-6 binding polypeptide
VDAKYAKEERKAWYEIHTLPNLTTDQVAAFISKLFDDPSQSSELLSEAKKLNDSQAPK

SEQ ID NO: 384 - protein, 58 aa, ARTIFICIAL SEQUENCE
  Engineered IL-6 binding polypeptide
VDAKYAKEEREAWHEIHLLPNLTIEQVAAFISKLFDDPSQSSELLSEAKKLNDSQAPK

SEQ ID NO: 385 - protein, 58 aa, ARTIFICIAL SEQUENCE
  Engineered IL-6 binding polypeptide
VDAKYAKEEQKAWWEIHLLPNLTTEQMAAFISKLFDDPSQSSELLSEAKKLNDSQAPK

SEQ ID NO: 386 - protein, 58 aa, ARTIFICIAL SEQUENCE
  Engineered IL-6 binding polypeptide
VDAKYAKEEQAAWLEIHLLPNLTVEQMAAFISKLFDDPSQSSELLSEAKKLNDSQAPK

SEQ ID NO: 387 - protein, 58 aa, ARTIFICIAL SEQUENCE
  Engineered IL-6 binding polypeptide
VDAKYAKEEREAWWEIHALPNLTTNQMAAFISKLFDDPSQSSELLSEAKKLNDSQAPK

SEQ ID NO: 388 - protein, 58 aa, ARTIFICIAL SEQUENCE
  Engineered IL-6 binding polypeptide
VDAKYAKEEAEAWYEIHILPNLTITQMAAFISKLFDDPSQSSELLSEAKKLNDSQAPK

SEQ ID NO: 389 - protein, 58 aa, ARTIFICIAL SEQUENCE
  Engineered IL-6 binding polypeptide
VDAKYAKEERQAWYEIHLLPNLTIEQMAAFISKLFDDPSQSSELLSEAKKLNDSQAPK

SEQ ID NO: 390 - protein, 58 aa, ARTIFICIAL SEQUENCE
  Engineered IL-6 binding polypeptide
VDAKYAKEEAKAWFEIHTLPNLTVTQMAAFISKLFDDPSQSSELLSEAKKLNDSQAPK

SEQ ID NO: 391 - protein, 58 aa, ARTIFICIAL SEQUENCE
  Engineered IL-6 binding polypeptide
VDAKYAKEEADAWWEIHSLPNLTVDQTAAFISKLFDDPSQSSELLSEAKKLNDSQAPK

SEQ ID NO: 392 - protein, 58 aa, ARTIFICIAL SEQUENCE
  Engineered IL-6 binding polypeptide
VDAKYAKEERVAWYEIHILPNLTVEQTAAFISKLFDDPSQSSELLSEAKKLNDSQAPK

SEQ ID NO: 393 - protein, 58 aa, ARTIFICIAL SEQUENCE
  Engineered IL-6 binding polypeptide
VDAKYAKEERKAWYEIHTLPNLTVDQMSAFISKLFDDPSQSSELLSEAKKLNDSQAPK

SEQ ID NO: 394 - protein, 58 aa, ARTIFICIAL SEQUENCE
  Engineered IL-6 binding polypeptide
VDAKYAKEEAQAWFEIHTLPNLTIEQMAAFIIKLYDDPSQSSELLSEAKKLNDSQAPK

SEQ ID NO: 395 - protein, 58 aa, ARTIFICIAL SEQUENCE
  Engineered IL-6 binding polypeptide
VDAKYAKEERQAWYEIHALPNLTVDQMAAFIIKLYDDPSQSSELLSEAKKLNDSQAPK

SEQ ID NO: 396 - protein, 58 aa, ARTIFICIAL SEQUENCE
  Engineered IL-6 binding polypeptide
VDAKYAKEEADAWFEIHVLPNLTTEQMTAFISKLFDDPSQSSELLSEAKKLNDSQAPK

SEQ ID NO: 397 - protein, 58 aa, ARTIFICIAL SEQUENCE
  Engineered IL-6 binding polypeptide
VDAKYAKEERRAWFEIHALPNLTVEQMAAFISKLFDDPSQSSELLSEAKKLNDSQAPK

SEQ ID NO: 398 - protein, 58 aa, ARTIFICIAL SEQUENCE
  Engineered IL-6 binding polypeptide
VDAKYAKEEAKAWYEIHSLPNLTVNQMAAFISKLFDDPSQSSELLSEAKKLNDSQAPK

SEQ ID NO: 399 - protein, 58 aa, ARTIFICIAL SEQUENCE
  Engineered IL-6 binding polypeptide
VDAKYAKEEARAWHEIHTLPNLTVHQMAAFIQKLFDDPSQSSELLSEAKKLNDSQAPK

SEQ ID NO: 400 - protein, 58 aa, ARTIFICIAL SEQUENCE
  Engineered IL-6 binding polypeptide
VDAKYAKEERRAWREIHTLPNLTVSQMAAFISKLFDDPSQSSELLSEAKKLNDSQAPK

SEQ ID NO: 401 - protein, 58 aa, ARTIFICIAL SEQUENCE
  Engineered IL-6 binding polypeptide
VDAKYAKEERAAWYEIHLLPNLTISQMAAFISKLFDDPSQSSELLSEAKKLNDSQAPK

SEQ ID NO: 402 - protein, 58 aa, ARTIFICIAL SEQUENCE
  Engineered IL-6 binding polypeptide
VDAKYAKEERKAWWEIHTLPNLTVSQMAAFISKLFDDPSQSSELLSEAKKLNDSQAPK

SEQ ID NO: 403 - protein, 58 aa, ARTIFICIAL SEQUENCE
  Engineered IL-6 binding polypeptide
VDAKYAKEERHAWYEIHMLPNLTIEQITAFISKLFDDPSQSSELLSEAKKLNDSQAPK

SEQ ID NO: 404 - protein, 58 aa, ARTIFICIAL SEQUENCE
  Engineered IL-6 binding polypeptide
VDAKYAKEEAQAWHEIHLLPNLTVEQMAAFIQKLFDDPSQSSELLSEAKKLNDSQAPK

SEQ ID NO: 405 - protein, 58 aa, ARTIFICIAL SEQUENCE
  Engineered IL-6 binding polypeptide
VDAKYAKEERKAWYEIHMLPNLTVDQIAAFISKLFDDPSQSSELLSEAKKLNDSQAPK

SEQ ID NO: 406 - protein, 58 aa, ARTIFICIAL SEQUENCE
  Engineered IL-6 binding polypeptide
VDAKYAKEEAHAWWEIHKLPNLTVEQVAAFISKLFDDPSQSSELLSEAKKLNDSQAPK

SEQ ID NO: 407 - protein, 58 aa, ARTIFICIAL SEQUENCE
  Engineered IL-6 binding polypeptide
VDAKYAKEERKAWWEIHLLPNLTVNQMAAFISKLFDDPSQSSELLSEAKKLNDSQAPK

SEQ ID NO: 408 - protein, 58 aa, ARTIFICIAL SEQUENCE
  Engineered IL-6 binding polypeptide
VDAKYAKEEREAWYEIHLLPNLTVSQMAAFISKLFDDPSQSSELLSEAKKLNDSQAPK

SEQ ID NO: 409 - protein, 58 aa, ARTIFICIAL SEQUENCE
  Engineered IL-6 binding polypeptide
VDAKYAKEEAKAWHEIHILPNLTVDQMAAFISKLFDDPSQSSELLSEAKKLNDSQAPK

SEQ ID NO: 410 - protein, 58 aa, ARTIFICIAL SEQUENCE
  Engineered IL-6 binding polypeptide
VDAKYAKEERHAWYEIHTLPNLTVEQMAAFIIKLFDDPSQSSELLSEAKKLNDSQAPK

SEQ ID NO: 411 - protein, 58 aa, ARTIFICIAL SEQUENCE
  Engineered IL-6 binding polypeptide
VDAKYAKEERHAWTEIHKLPNLTVQQMAAFISKLFDDPSQSSELLSEAKKLNDSQAPK

SEQ ID NO: 412 - protein, 58 aa, ARTIFICIAL SEQUENCE
  Engineered IL-6 binding polypeptide
VDAKYAKEERDAWHEIHTLPNLTVNQMAAFISKLFDDPSQSSELLSEAKKLNDSQAPK

SEQ ID NO: 413 - protein, 58 aa, ARTIFICIAL SEQUENCE
  Engineered IL-6 binding polypeptide
VDAKYAKEEREAWYEIHLLPNLTTNQRSAFISKLFDDPSQSSELLSEAKKLNDSQAPK

SEQ ID NO: 414 - protein, 58 aa, ARTIFICIAL SEQUENCE
  Engineered IL-6 binding polypeptide
VDAKYAKEEAVAWREIHLLPNLTVNQMAAFISKLFDDPSQSSELLSEAKKLNDSQAPK

SEQ ID NO: 415 - protein, 58 aa, ARTIFICIAL SEQUENCE
  Engineered IL-6 binding polypeptide
VDAKYAKEERAAWTEIHLLPNLTVDQIAAFISKLFDDPSQSSELLSEAKKLNDSQAPK

SEQ ID NO: 416 - protein, 58 aa, ARTIFICIAL SEQUENCE
  Engineered IL-6 binding polypeptide
VDAKYAKEEQAAWFEIHVLPNLTIEQRAAFISKLFDDPSQSSELLSEAKKLNDSQAPK

SEQ ID NO: 417 - protein, 58 aa, ARTIFICIAL SEQUENCE
  Engineered IL-6 binding polypeptide
VDAKYAKEERTAWWEIHALPNLTVEQIAAFISKLFDDPSQSSELLSEAKKLNDSQAPK

SEQ ID NO: 418 - protein, 58 aa, ARTIFICIAL SEQUENCE
  Engineered IL-6 binding polypeptide
VDAKYAKEEAEAWFEIHTLPNLTVDQRVAFIIKLFDDPSQSSELLSEAKKLNDSQAPK

SEQ ID NO: 419 - protein, 58 aa, ARTIFICIAL SEQUENCE
  Engineered IL-6 binding polypeptide
VDAKYAKEEREAWFEIHTLPNLTINQMAAFIIKLFDDPSQSSELLSEAKKLNDSQAPK

SEQ ID NO: 420 - protein, 58 aa, ARTIFICIAL SEQUENCE
  Engineered IL-6 binding polypeptide
VDAKYAKEERQAWFEIHALPNLTVQQRAAFISKLFDDPSQSSELLSEAKKLNDSQAPK

SEQ ID NO: 421 - protein, 58 aa, ARTIFICIAL SEQUENCE
  Engineered IL-6 binding polypeptide
VDAKYAKEEREAWHEIHLLPNLTIDQLAAFISKLFDDPSQSSELLSEAKKLNDSQAPK

SEQ ID NO: 422 - protein, 58 aa, ARTIFICIAL SEQUENCE
  Engineered IL-6 binding polypeptide
VDAKYAKEEHHAWWEIHALPNLTVDQVAAFIIKLYDDPSQSSELLSEAKKLNDSQAPK

SEQ ID NO: 423 - protein, 58 aa, ARTIFICIAL SEQUENCE
  Engineered IL-6 binding polypeptide
VDAKYAKEEAKAWYEIHILPNLTVTQITAFISKLFDDPSQSSELLSEAKKLNDSQAPK

SEQ ID NO: 424 - protein, 58 aa, ARTIFICIAL SEQUENCE
  Engineered IL-6 binding polypeptide
VDAKYAKEEQQAWFEIHTLPNLTVQQVTAFISKLFDDPSQSSELLSEAKKLNDSQAPK

SEQ ID NO: 425 - protein, 58 aa, ARTIFICIAL SEQUENCE
  Engineered IL-6 binding polypeptide
VDAKYAKEERTAWWEIHTLPNLTVTQMAAFISKLFDDPSQSSELLSEAKKLNDSQAPK

SEQ ID NO: 426 - protein, 58 aa, ARTIFICIAL SEQUENCE
  Engineered IL-6 binding polypeptide
VDAKYAKEERAAWYEIHLLPNLTVDQMSAFISKLFDDPSQSSELLSEAKKLNDSQAPK

SEQ ID NO: 427 - protein, 58 aa, ARTIFICIAL SEQUENCE
  Engineered IL-6 binding polypeptide
VDAKYAKEEQQAWWEIHALPNLTVDQITAFISKLFDDPSQSSELLSEAKKLNDSQAPK

SEQ ID NO: 428 - protein, 58 aa, ARTIFICIAL SEQUENCE
  Engineered IL-6 binding polypeptide
VDAKYAKEERRAWYEIHTLPNLTVSQMAAFIIKLFDDPSQSSELLSEAKKLNDSQAPK

SEQ ID NO: 429 - protein, 58 aa, ARTIFICIAL SEQUENCE
  Engineered IL-6 binding polypeptide
VDAKYAKEEQRAWTEIHMLPNLTANQMAAFISKLFDDPSQSSELLSEAKKLNDSQAPK

SEQ ID NO: 430 - protein, 58 aa, ARTIFICIAL SEQUENCE
  Engineered IL-6 binding polypeptide
VDAKYAKEEHEAWYEIHVLPNLTVNQISAFISKLFDDPSQSSELLSEAKKLNDSQAPK

SEQ ID NO: 431 - protein, 58 aa, ARTIFICIAL SEQUENCE
  Engineered IL-6 binding polypeptide
VDAKYAKEEADAWHEIHLLPNLTVEQMAAFIQKLFDDPSQSSELLSEAKKLNDSQAPK

SEQ ID NO: 432 - protein, 58 aa, ARTIFICIAL SEQUENCE
  Engineered IL-6 binding polypeptide
VDAKYAKEEREAWFEIHALPNLTVTQMAAFISKLFDDPSQSSELLSEAKKLNDSQAPK

SEQ ID NO: 433 - protein, 58 aa, ARTIFICIAL SEQUENCE
  Engineered IL-6 binding polypeptide
VDAKYAKEERDAWYEIHLLPNLTVEQMAAFIQKLFDDPSQSSELLSEAKKLNDSQAPK

SEQ ID NO: 434 - protein, 58 aa, ARTIFICIAL SEQUENCE
  Engineered IL-6 binding polypeptide
VDAKYAKEERKAWFEIHLLPNLTVTQMAAFISKLFDDPSQSSELLSEAKKLNDSQAPK

SEQ ID NO: 435 - protein, 58 aa, ARTIFICIAL SEQUENCE
  Engineered IL-6 binding polypeptide
VDAKYAKEEAEAWSEIHLLPNLTVEQMAAFISKLFDDPSQSSELLSEAKKLNDSQAPK

SEQ ID NO: 436 - protein, 58 aa, ARTIFICIAL SEQUENCE
  Engineered IL-6 binding polypeptide
VDAKYAKEERKAWYEIHSLPNLTVNQMAAFIIKLFDDPSQSSELLSEAKKLNDSQAPK

SEQ ID NO: 437 - protein, 58 aa, ARTIFICIAL SEQUENCE
  Engineered IL-6 binding polypeptide
VDAKYAKEEAAAWHEIHVLPNLTVDQMAAFIIKLYDDPSQSSELLSEAKKLNDSQAPK

SEQ ID NO: 438 - protein, 58 aa, ARTIFICIAL SEQUENCE
  Engineered IL-6 binding polypeptide
VDAKYAKEERHAWTEIHKLPNLTIQQITAFISKLFDDPSQSSELLSEAKKLNDSQAPK

SEQ ID NO: 439 - protein, 58 aa, ARTIFICIAL SEQUENCE
  Engineered IL-6 binding polypeptide
VDAKYAKEERRAWFEIHALPNLTVQQMVAFISKLFDDPSQSSELLSEAKKLNDSQAPK

SEQ ID NO: 440 - protein, 58 aa, ARTIFICIAL SEQUENCE
  Engineered IL-6 binding polypeptide
VDAKYAKEERDAWYEIHILPNLTVNQIAAFISKLFDDPSQSSELLSEAKKLNDSQAPK

SEQ ID NO: 441 - protein, 58 aa, ARTIFICIAL SEQUENCE
  Engineered IL-6 binding polypeptide
VDAKYAKEEAEAWHEIHVLPNLTVNQMAAFISKLFDDPSQSSELLSEAKKLNDSQAPK

SEQ ID NO: 442 - protein, 58 aa, ARTIFICIAL SEQUENCE
  Engineered IL-6 binding polypeptide
VDAKYAKEEARAWHEIHLLPNLTIQQMAAFISKLFDDPSQSSELLSEAKKLNDSQAPK

SEQ ID NO: 443 - protein, 58 aa, ARTIFICIAL SEQUENCE
  Engineered IL-6 binding polypeptide
VDAKYAKEEAQAWWEIHALPNLTVDQTAAFIIKLFDDPSQSSELLSEAKKLNDSQAPK

SEQ ID NO: 444 - protein, 58 aa, ARTIFICIAL SEQUENCE
  Engineered IL-6 binding polypeptide
VDAKYAKEEADAWFEIHTLPNLTVEQIAAFISKLFDDPSQSSELLSEAKKLNDSQAPK

SEQ ID NO: 445 - protein, 58 aa, ARTIFICIAL SEQUENCE
  Engineered IL-6 binding polypeptide
VDAKYAKEEAAAWYEIHILPNLTVQQMAAFISKLFDDPSQSSELLSEAKKLNDSQAPK

SEQ ID NO: 446 - protein, 58 aa, ARTIFICIAL SEQUENCE
  Engineered IL-6 binding polypeptide
VDAKYAKEEAEAWFEIHVLPNLTVSQIAAFISKLFDDPSQSSELLSEAKKLNDSQAPK

SEQ ID NO: 447 - protein, 58 aa, ARTIFICIAL SEQUENCE
  Engineered IL-6 binding polypeptide
VDAKYAKEEQSAWYEIHLLPNLTTNQLTAFISKLFDDPSQSSELLSEAKKLNDSQAPK

SEQ ID NO: 448 - protein, 58 aa, ARTIFICIAL SEQUENCE
  Engineered IL-6 binding polypeptide
VDAKYAKEEARAWYEIHTLPNLTATQMAAFISKLFDDPSQSSELLSEAKKLNDSQAPK

SEQ ID NO: 449 - protein, 58 aa, ARTIFICIAL SEQUENCE
  Engineered IL-6 binding polypeptide
VDAKYAKEEADAWWEIHALPNLTVDQVTAFIIKLYDDPSQSSELLSEAKKLNDSQAPK

SEQ ID NO: 450 - protein, 58 aa, ARTIFICIAL SEQUENCE
  Engineered IL-6 binding polypeptide
VDAKYAKEEAHAWREIHILPNLTVNQMAAFISKLFDDPSQSSELLSEAKKLNDSQAPK

SEQ ID NO: 451 - protein, 58 aa, ARTIFICIAL SEQUENCE
  Engineered IL-6 binding polypeptide
VDAKYAKEEAQAWHEIHLLPNLTVHQMAAFISKLFDDPSQSSELLSEAKKLNDSQAPK

SEQ ID NO: 452 - protein, 58 aa, ARTIFICIAL SEQUENCE
  Engineered IL-6 binding polypeptide
VDAKYAKEEARAWHEIHILPNLTTDQMAAFISKLFDDPSQSSELLSEAKKLNDSQAPK

SEQ ID NO: 453 - protein, 58 aa, ARTIFICIAL SEQUENCE
  Engineered IL-6 binding polypeptide
VDAKYAKEERHAWHEIHILPNLTVDQMAAFISKLFDDPSQSSELLSEAKKLNDSQAPK

SEQ ID NO: 454 - protein, 58 aa, ARTIFICIAL SEQUENCE
  Engineered IL-6 binding polypeptide
VDAKYAKEERHAWREIHLLPNLTVNQMAAFISKLFDDPSQSSELLSEAKKLNDSQAPK

SEQ ID NO: 455 - protein, 58 aa, ARTIFICIAL SEQUENCE
  Engineered IL-6 binding polypeptide
VDAKYAKEERTAWWEIHALPNLTVSQVAAFISKLFDDPSQSSELLSEAKKLNDSQAPK

SEQ ID NO: 456 - protein, 58 aa, ARTIFICIAL SEQUENCE
  Engineered IL-6 binding polypeptide
VDAKYAKEERHAWYEIHILPNLTVDQMAAFITKLFDDPSQSSELLSEAKKLNDSQAPK

SEQ ID NO: 457 - protein, 58 aa, ARTIFICIAL SEQUENCE
  Engineered IL-6 binding polypeptide
VDAKYAKEEQRAWREIHLLPNLTVDQMAAFISKLFDDPSQSSELLSEAKKLNDSQAPK

SEQ ID NO: 458 - protein, 58 aa, ARTIFICIAL SEQUENCE
  Engineered IL-6 binding polypeptide
VDAKYAKEERQAWYEIHVLPNLTVHQMAAFISKLFDDPSQSSELLSEAKKLNDSQAPK

SEQ ID NO: 459 - protein, 58 aa, ARTIFICIAL SEQUENCE
  Engineered IL-6 binding polypeptide
VDAKYAKEEAQAWHEIHTLPNLTVSQMAAFISKLFDDPSQSSELLSEAKKLNDSQAPK

SEQ ID NO: 460 - protein, 58 aa, ARTIFICIAL SEQUENCE
  Engineered IL-6 binding polypeptide
VDAKYAKEEREAWLEIHLLPNLTIDQMSAFISKLFDDPSQSSELLSEAKKLNDSQAPK

SEQ ID NO: 461 - protein, 58 aa, ARTIFICIAL SEQUENCE
  Engineered IL-6 binding polypeptide
VDAKYAKEEHRAWFEIHLLPNLTTEQMAAFISKLFDDPSQSSELLSEAKKLNDSQAPK

SEQ ID NO: 462 - protein, 58 aa, ARTIFICIAL SEQUENCE
  Engineered IL-6 binding polypeptide
VDAKYAKEERRAWYEIHLLPNLTTDQMAAFISKLFDDPSQSSELLSEAKKLNDSQAPK

SEQ ID NO: 463 - protein, 58 aa, ARTIFICIAL SEQUENCE
  Engineered IL-6 binding polypeptide
VDAKYAKEEREAWYEIHILPNLTVSQIAAFISKLFDDPSQSSELLSEAKKLNDSQAPK

SEQ ID NO: 464 - protein, 58 aa, ARTIFICIAL SEQUENCE
  Engineered IL-6 binding polypeptide
VDAKYAKEERDAWYEIHILPNLTVDQMAAFISKLFDDPSQSSELLSEAKKLNDSQAPK

SEQ ID NO: 465 - protein, 58 aa, ARTIFICIAL SEQUENCE
  Engineered IL-6 binding polypeptide
VDAKYAKEERDAWYEIHLLPNLTVSQMAAFISKLFDDPSQSSELLSEAKKLNDSQAPK

SEQ ID NO: 466 - protein, 58 aa, ARTIFICIAL SEQUENCE
  Engineered IL-6 binding polypeptide
VDAKYAKEERTAWFEIHSLPNLTAEQMAAFIIKLYDDPSQSSELLSEAKKLNDSQAPK

SEQ ID NO: 467 - protein, 58 aa, ARTIFICIAL SEQUENCE
  Engineered IL-6 binding polypeptide
VDAKYAKEEHRAWLEIHTLPNLTVDQMAAFISKLFDDPSQSSELLSEAKKLNDSQAPK

SEQ ID NO: 468 - protein, 58 aa, ARTIFICIAL SEQUENCE
  Engineered IL-6 binding polypeptide
VDAKYAKEEHAAWYEIHLLPNLTVSQISAFIQKLFDDPSQSSELLSEAKKLNDSQAPK

SEQ ID NO: 469 - protein, 58 aa, ARTIFICIAL SEQUENCE
  Engineered IL-6 binding polypeptide
VDAKYAKEEADAWYEIHALPNLTVDQMAAFISKLFDDPSQSSELLSEAKKLNDSQAPK

SEQ ID NO: 470 - protein, 58 aa, ARTIFICIAL SEQUENCE
  Engineered IL-6 binding polypeptide
VDAKYAKEEAEAWWEIHTLPNLTVDQMAAFISKLFDDPSQSSELLSEAKKLNDSQAPK

SEQ ID NO: 471 - protein, 58 aa, ARTIFICIAL SEQUENCE
  Engineered IL-6 binding polypeptide
VDAKYAKEEAEAWWEIHKLPNLTVEQMTAFIIKLYDDPSQSSELLSEAKKLNDSQAPK

SEQ ID NO: 472 - protein, 58 aa, ARTIFICIAL SEQUENCE
  Engineered IL-6 binding polypeptide
VDAKYAKEEHHAWREIHILPNLTVEQMAAFIIKLFDDPSQSSELLSEAKKLNDSQAPK

SEQ ID NO: 473 - protein, 58 aa, ARTIFICIAL SEQUENCE
  Engineered IL-6 binding polypeptide
VDAKYAKEEREAWYEIHLLPNLTIQQMAAFISKLFDDPSQSSELLSEAKKLNDSQAPK

SEQ ID NO: 474 - protein, 58 aa, ARTIFICIAL SEQUENCE
  Engineered IL-6 binding polypeptide
VDAKYAKEEHAAWLEIHLLPNLTIDQMAAFISKLFDDPSQSSELLSEAKKLNDSQAPK

SEQ ID NO: 475 - protein, 58 aa, ARTIFICIAL SEQUENCE
  Engineered IL-6 binding polypeptide
VDAKYAKEERAAWYEIHLLPNLTIHQMAAFISKLFDDPSQSSELLSEAKKLNDSQAPK

SEQ ID NO: 476 - protein, 58 aa, ARTIFICIAL SEQUENCE
  Engineered IL-6 binding polypeptide
VDAKYAKEERTAWYEIHLLPNLTVHQMAAFISKLFDDPSQSSELLSEAKKLNDSQAPK

SEQ ID NO: 477 - protein, 58 aa, ARTIFICIAL SEQUENCE
  Engineered IL-6 binding polypeptide
VDAKYAKEERHAWHEIHSLPNLTIDQLTAFISKLFDDPSQSSELLSEAKKLNDSQAPK

SEQ ID NO: 478 - protein, 58 aa, ARTIFICIAL SEQUENCE
  Engineered IL-6 binding polypeptide
VDAKYAKEEREAWYEIHSLPNLTVDQVAAFISKLFDDPSQSSELLSEAKKLNDSQAPK

SEQ ID NO: 479 - protein, 58 aa, ARTIFICIAL SEQUENCE
  Engineered IL-6 binding polypeptide
VDAKYAKEEHHAWHEIHTLPNLTVHQMAAFISKLFDDPSQSSELLSEAKKLNDSQAPK

SEQ ID NO: 480 - protein, 58 aa, ARTIFICIAL SEQUENCE
  Engineered IL-6 binding polypeptide
VDAKYAKEEAHAWHEIHLLPNLTVEQMAAFISKLFDDPSQSSELLSEAKKLNDSQAPK

SEQ ID NO: 481 - protein, 58 aa, ARTIFICIAL SEQUENCE
  Engineered IL-6 binding polypeptide
VDAKYAKEEAHAWWEIHKLPNLTVNQVAAFISKLFDDPSQSSELLSEAKKLNDSQAPK

SEQ ID NO: 482 - protein, 58 aa, ARTIFICIAL SEQUENCE
  Engineered IL-6 binding polypeptide
VDAKYAKEEARAWYEIHILPNLTVTQMAAFISKLFDDPSQSSELLSEAKKLNDSQAPK

SEQ ID NO: 483 - protein, 58 aa, ARTIFICIAL SEQUENCE
  Engineered IL-6 binding polypeptide
VDAKYAKEEARAWWEIHLLPNLTVDQISAFISKLFDDPSQSSELLSEAKKLNDSQAPK

SEQ ID NO: 484 - protein, 58 aa, ARTIFICIAL SEQUENCE
  Engineered IL-6 binding polypeptide
VDAKYAKEEHDAWFEIHLLPNLTVEQIAAFISKLFDDPSQSSELLSEAKKLNDSQAPK

SEQ ID NO: 485 - protein, 58 aa, ARTIFICIAL SEQUENCE
  Engineered IL-6 binding polypeptide
VDAKYAKEEHTAWYEIHLLPNLTVDQMAAFISKLFDDPSQSSELLSEAKKLNDSQAPK

SEQ ID NO: 486 - protein, 58 aa, ARTIFICIAL SEQUENCE
  Engineered IL-6 binding polypeptide
VDAKYAKEEREAWWEIHALPNLTVNQMAAFIIKLFDDPSQSSELLSEAKKLNDSQAPK

SEQ ID NO: 487 - protein, 58 aa, ARTIFICIAL SEQUENCE
  Engineered IL-6 binding polypeptide
VDAKYAKEERDAWYEISTLPNLTVEQAAAFISKLFDDPSQSSELLSEAKKLNDSQAPK

SEQ ID NO: 488 - protein, 58 aa, ARTIFICIAL SEQUENCE
  Engineered IL-6 binding polypeptide
VDAKYAKEEREAWYEIHLLPNLTITQMAAFISKLFDDPSQSSELLSEAKKLNDSQAPK

SEQ ID NO: 489 - protein, 58 aa, ARTIFICIAL SEQUENCE
  Engineered IL-6 binding polypeptide
VDAKYAKEEAKAWFEIHTLPNLTVDQVAAFISKLFDDPSQSSELLSEAKKLNDSQAPK

SEQ ID NO: 490 - protein, 58 aa, ARTIFICIAL SEQUENCE
  Engineered IL-6 binding polypeptide
VDAKYAKEERQAWWEIHTLPNLTVEQMSAFISKLYDDPSQSSELLSEAKKLNDSQAPK

SEQ ID NO: 491 - protein, 58 aa, ARTIFICIAL SEQUENCE
  Engineered IL-6 binding polypeptide
VDAKYAKEEHEAWHEIHILPNLTIDQMAAFISKLFDDPSQSSELLSEAKKLNDSQAPK

SEQ ID NO: 492 - protein, 58 aa, ARTIFICIAL SEQUENCE
  Engineered IL-6 binding polypeptide
VDAKYAKEERDAWFEIHLLPNLTVEQMAAFISKLFDDPSQSSELLSEAKKLNDSQAPK

SEQ ID NO: 493 - protein, 58 aa, ARTIFICIAL SEQUENCE
  Engineered IL-6 binding polypeptide
VDAKYAKEEAKAWWEIHSLPNLTVNQMAAFISKLFDDPSQSSELLSEAKKLNDSQAPK

SEQ ID NO: 494 - protein, 58 aa, ARTIFICIAL SEQUENCE
  Engineered IL-6 binding polypeptide
VDAKYAKEEARAWWEIHLLPNLTIDQMAAFISKLFDDPSQSSELLSEAKKLNDSQAPK

SEQ ID NO: 495 - protein, 58 aa, ARTIFICIAL SEQUENCE
  Engineered IL-6 binding polypeptide
VDAKYAKEEQKAWWEIHSLPNLTVDQITAFISKLFDDPSQSSELLSEAKKLNDSQAPK

SEQ ID NO: 496 - protein, 58 aa, ARTIFICIAL SEQUENCE
  Engineered IL-6 binding polypeptide
VDAKYAKEEREAWYEIHLLPNLTVSQIAAFISKLFDDPSQSSELLSEAKKLNDSQAPK

SEQ ID NO: 497 - protein, 58 aa, ARTIFICIAL SEQUENCE
  Engineered IL-6 binding polypeptide
VDAKYAKEERRAWHEIQTLPNLTVRQMAAFISKLFDDPSQSSELLSEAKKLNDSQAPK

SEQ ID NO: 498 - protein, 58 aa, ARTIFICIAL SEQUENCE
  Engineered IL-6 binding polypeptide
VDAKYAKEERQAWYEIHTLPNLTATQMAAFIQKLFDDPSQSSELLSEAKKLNDSQAPK

SEQ ID NO: 499 - protein, 58 aa, ARTIFICIAL SEQUENCE
  Engineered IL-6 binding polypeptide
VDAKYAKEERHAWTEIHLLPNLTVNQMAAFIIKLFDDPSQSSELLSEAKKLNDSQAPK

SEQ ID NO: 500 - protein, 58 aa, ARTIFICIAL SEQUENCE
  Engineered IL-6 binding polypeptide
VDAKYAKEEARAWHEIHVLPNLTVNQMTAFISKLFDDPSQSSELLSEAKKLNDSQAPK

SEQ ID NO: 501 - protein, 58 aa, ARTIFICIAL SEQUENCE
  Engineered IL-6 binding polypeptide
VDAKYAKEEAEAWYEIHILPNLTVNQIAAFISKLFDDPSQSSELLSEAKKLNDSQAPK

SEQ ID NO: 502 - protein, 58 aa, ARTIFICIAL SEQUENCE
  Engineered IL-6 binding polypeptide
VDAKYAKEEAEAWREIHLLPNLTVDQMAAFISKLFDDPSQSSELLSEAKKLNDSQAPK

SEQ ID NO: 503 - protein, 58 aa, ARTIFICIAL SEQUENCE
  Engineered IL-6 binding polypeptide
VDAKYAKEERSAWFEIHTLPNLTVDQMAAFISKLFDDPSQSSELLSEAKKLNDSQAPK

SEQ ID NO: 504 - protein, 58 aa, ARTIFICIAL SEQUENCE
  Engineered IL-6 binding polypeptide
VDAKYAKEEAQAWYEIHALPNLTVEQMAAFISKLFDDPSQSSELLSEAKKLNDSQAPK

SEQ ID NO: 505 - protein, 58 aa, ARTIFICIAL SEQUENCE
  Engineered IL-6 binding polypeptide
VDAKYAKEERTAWWEIHALPNLTVNQVTAFISKLFDDPSQSSELLSEAKKLNDSQAPK

SEQ ID NO: 506 - protein, 58 aa, ARTIFICIAL SEQUENCE
  Engineered IL-6 binding polypeptide
VDAKYAKEEAEAWFEIHVLPNLTTDQRVAFITKLFDDPSQSSELLSEAKKLNDSQAPK

SEQ ID NO: 507 - protein, 58 aa, ARTIFICIAL SEQUENCE
  Engineered IL-6 binding polypeptide
VDAKYAKEEAEAWYEIHVLPNLTVDQMAAFIQKLFDDPSQSSELLSEAKKLNDSQAPK

SEQ ID NO: 508 - protein, 58 aa, ARTIFICIAL SEQUENCE
  Engineered IL-6 binding polypeptide
VDAKYAKEEREAWLEIHLLPNLTVEQMAAFISKLFDDPSQSSELLSEAKKLNDSQAPK

SEQ ID NO: 509 - protein, 58 aa, ARTIFICIAL SEQUENCE
  Engineered IL-6 binding polypeptide
VDAKYAKEERAAWWEIHSLPNLTVSQMAAFISKLFDDPSQSSELLSEAKKLNDSQAPK

SEQ ID NO: 510 - protein, 58 aa, ARTIFICIAL SEQUENCE
  Engineered IL-6 binding polypeptide
VDAKYAKEEAKAWREIHLLPNLTVNQMAAFISKLFDDPSQSSELLSEAKKLNDSQAPK

SEQ ID NO: 511 - protein, 58 aa, ARTIFICIAL SEQUENCE
  Engineered IL-6 binding polypeptide
VDAKYAKEERQAWWEIHALPNLTVTQMAAFISKLFDDPSQSSELLSEAKKLNDSQAPK

SEQ ID NO: 512 - protein, 58 aa, ARTIFICIAL SEQUENCE
  Engineered IL-6 binding polypeptide
VDAKYAKEERDAWFEIHTLPNLTVDQMAAFIQKLFDDPSQSSELLSEAKKLNDSQAPK

SEQ ID NO: 513 - protein, 58 aa, ARTIFICIAL SEQUENCE
  Engineered IL-6 binding polypeptide
VDAKYAKEERRAWYEIHSLPNLTVNQMAAFISKLFDDPSQSSELLSEAKKLNDSQAPK

SEQ ID NO: 514 - protein, 58 aa, ARTIFICIAL SEQUENCE
  Engineered IL-6 binding polypeptide
VDAKYAKEEHQAWHEIHLLPNLTVSQMAAFIQKLFDDPSQSSELLSEAKKLNDSQAPK

SEQ ID NO: 515 - protein, 58 aa, ARTIFICIAL SEQUENCE
  Engineered IL-6 binding polypeptide
VDAKYAKEERHAWFEIHKLPNLTTDQIAAFISKLFDDPSQSSELLSEAKKLNDSQAPK

SEQ ID NO: 516 - protein, 58 aa, ARTIFICIAL SEQUENCE
  Engineered IL-6 binding polypeptide
VDAKYAKEEAHAWHEIHLLPNLTIDQMAAFIMKLFDDPSQSSELLSEAKKLNDSQAPK

SEQ ID NO: 517 - protein, 58 aa, ARTIFICIAL SEQUENCE
  Engineered IL-6 binding polypeptide
VDAKYAKEERAAWYEIHLLPNLTIEQMSAFISKLFDDPSQSSELLSEAKKLNDSQAPK

SEQ ID NO: 518 - protein, 58 aa, ARTIFICIAL SEQUENCE
  Engineered IL-6 binding polypeptide
VDAKYAKEEAKAWFEIHALPNLTTTQMAAFISKLFDDPSQSSELLSEAKKLNDSQAPK

SEQ ID NO: 519 - protein, 58 aa, ARTIFICIAL SEQUENCE
  Engineered IL-6 binding polypeptide
VDAKYAKEERKAWYEIHILPNLTVDQMAAFISKLFDDPSQSSELLSEAKKLNDSQAPK

SEQ ID NO: 520 - protein, 58 aa, ARTIFICIAL SEQUENCE
  Engineered IL-6 binding polypeptide
VDAKYAKEERQAWHEIHILPNLTITQRTAFISKLFDDPSQSSELLSEAKKLNDSQAPK

SEQ ID NO: 521 - protein, 58 aa, ARTIFICIAL SEQUENCE
  Engineered IL-6 binding polypeptide
VDAKYAKEERRAWYEIHTLPNLTITQMAAFIQKLFDDPSQSSELLSEAKKLNDSQAPK

SEQ ID NO: 522 - protein, 58 aa, ARTIFICIAL SEQUENCE
  Engineered IL-6 binding polypeptide
VDAKYAKEEAEAWLEIHLLPNLTVSQMAAFIWKLFDDPSQSSELLSEAKKLNDSQAPK

SEQ ID NO: 523 - protein, 58 aa, ARTIFICIAL SEQUENCE
  Engineered IL-6 binding polypeptide
VDAKYAKEEAHAWWEIHALPNLTTNQMAAFISKLFDDPSQSSELLSEAKKLNDSQAPK

SEQ ID NO: 524 - protein, 58 aa, ARTIFICIAL SEQUENCE
  Engineered IL-6 binding polypeptide
VDAKYAKEERHAWTEIHKLPNLTINQMVAFIIKLFDDPSQSSELLSEAKKLNDSQAPK

SEQ ID NO: 525 - protein, 58 aa, ARTIFICIAL SEQUENCE
  Engineered IL-6 binding polypeptide
VDAKYAKEERQAWTEIHLLPNLTVDQMAAFISKLFDDPSQSSELLSEAKKLNDSQAPK

SEQ ID NO: 526 - protein, 58 aa, ARTIFICIAL SEQUENCE
  Engineered IL-6 binding polypeptide
VDAKYAKEEAHAWHEIHILPNLTVRQMAAFISKLFDDPSQSSELLSEAKKLNDSQAPK

SEQ ID NO: 527 - protein, 58 aa, ARTIFICIAL SEQUENCE
  Engineered IL-6 binding polypeptide
VDAKYAKEERQAWHEIHTLPNLTVNQMAAFISKLFDDPSQSSELLSEAKKLNDSQAPK

SEQ ID NO: 528 - protein, 58 aa, ARTIFICIAL SEQUENCE
  Engineered IL-6 binding polypeptide
VDAKYAKEERHAWWEIHKLPNLTVNQMAAFISKLFDDPSQSSELLSEAKKLNDSQAPK

SEQ ID NO: 529 - protein, 58 aa, ARTIFICIAL SEQUENCE
  Engineered IL-6 binding polypeptide
VDAKYAKEEAKAWFEIHKLPNLTANQMAAFIIKLYDDPSQSSELLSEAKKLNDSQAPK

SEQ ID NO: 530 - protein, 58 aa, ARTIFICIAL SEQUENCE
  Engineered IL-6 binding polypeptide
VDAKYAKEEREAWYEIHILPNLTVQQRVAFISKLFDDPSQSSELLSEAKKLNDSQAPK

SEQ ID NO: 531 - protein, 58 aa, ARTIFICIAL SEQUENCE
  Engineered IL-6 binding polypeptide
VDAKYAKEEQEAWHEIHILPNLTVTQMTAFISKLFDDPSQSSELLSEAKKLNDSQAPK

SEQ ID NO: 532 - protein, 58 aa, ARTIFICIAL SEQUENCE
  Engineered IL-6 binding polypeptide
VDAKYAKEERQAWFEIHVLPNLTIEQMAAFISKLFDDPSQSSELLSEAKKLNDSQAPK

SEQ ID NO: 533 - protein, 58 aa, ARTIFICIAL SEQUENCE
  Engineered IL-6 binding polypeptide
VDAKYAKEERQAWYEIHKLPNLTVSQMTAFISKLFDDPSQSSELLSEAKKLNDSQAPK

SEQ ID NO: 534 - protein, 58 aa, ARTIFICIAL SEQUENCE
  Engineered IL-6 binding polypeptide
VDAKYAKEEREAWWEIHLLPNLTIDQMAAFIQKLFDDPSQSSELLSEAKKLNDSQAPK

SEQ ID NO: 535 - protein, 58 aa, ARTIFICIAL SEQUENCE
  Engineered IL-6 binding polypeptide
VDAKYAKEERDAWYEIHTLPNLTVHQMAAFISKLFDDPSQSSELLSEAKKLNDSQAPK

SEQ ID NO: 536 - protein, 58 aa, ARTIFICIAL SEQUENCE
  Engineered IL-6 binding polypeptide
VDAKYAKEEQAAWFEIHALPNLTVSQMAAFISKLFDDPSQSSELLSEAKKLNDSQAPK

SEQ ID NO: 537 - protein, 58 aa, ARTIFICIAL SEQUENCE
  Engineered IL-6 binding polypeptide
VDAKYAKEEAHAWYEIHILPNLTVRQIAAFIQKLFDDPSQSSELLSEAKKLNDSQAPK

SEQ ID NO: 538 - protein, 58 aa, ARTIFICIAL SEQUENCE
  Engineered IL-6 binding polypeptide
VDAKYAKEEAKAWWEIHSLPNLTAEQVSAFIQKLFDDPSQSSELLSEAKKLNDSQAPK

SEQ ID NO: 539 - protein, 58 aa, ARTIFICIAL SEQUENCE
  Engineered IL-6 binding polypeptide
VDAKYAKEEQKAWHEIHILPNLTTHQRVAFISKLFDDPSQSSELLSEAKKLNDSQAPK

SEQ ID NO: 540 - protein, 58 aa, ARTIFICIAL SEQUENCE
  Engineered IL-6 binding polypeptide
VDAKYAKEERQAWYEIHALPNLTVTQMAAFISKLFDDPSQSSELLSEAKKLNDSQAPK

SEQ ID NO: 541 - protein, 58 aa, ARTIFICIAL SEQUENCE
  Engineered IL-6 binding polypeptide
VDAKYAKEERDAWYEIHILPNLTVSQMSAFIQKLFDDPSQSSELLSEAKKLNDSQAPK

SEQ ID NO: 542 - protein, 58 aa, ARTIFICIAL SEQUENCE
  Engineered IL-6 binding polypeptide
VDAKYAKEEHDAWYEIHLLPNLTVQQMAAFISKLFDDPSQSSELLSEAKKLNDSQAPK

SEQ ID NO: 543 - protein, 58 aa, ARTIFICIAL SEQUENCE
  Engineered IL-6 binding polypeptide
VDAKYAKEEAHAWREIHLLPNLTVHQRTAFISKLFDDPSQSSELLSEAKKLNDSQAPK

SEQ ID NO: 544 - protein, 58 aa, ARTIFICIAL SEQUENCE
  Engineered IL-6 binding polypeptide
VDAKYAKEERHAWREIHLLPNLTHTQMAAFISKLFDDPSQSSELLSEAKKLNDSQAPK

SEQ ID NO: 545 - protein, 58 aa, ARTIFICIAL SEQUENCE
  Engineered IL-6 binding polypeptide
VDAKYAKEERHAWYEIHVLPNLTIQQMAAFIQKLFDDPSQSSELLSEAKKLNDSQAPK

SEQ ID NO: 546 - protein, 58 aa, ARTIFICIAL SEQUENCE
  Engineered IL-6 binding polypeptide
VDAKYAKEERKAWYEIHILPNLTTNQMAAFISKLFDDPSQSSELLSEAKKLNDSQAPK

SEQ ID NO: 547 - protein, 58 aa, ARTIFICIAL SEQUENCE
  Engineered IL-6 binding polypeptide
VDAKYAKEERDAWREIHLLPNLTVRQLSAFISKLFDDPSQSSELLSEAKKLNDSQAPK

SEQ ID NO: 548 - protein, 58 aa, ARTIFICIAL SEQUENCE
  Engineered IL-6 binding polypeptide
VDAKYAKEERQAWYEIHLLPNLTTQQMAAFIQKLFDDPSQSSELLSEAKKLNDSQAPK

SEQ ID NO: 549 - protein, 58 aa, ARTIFICIAL SEQUENCE
  Engineered IL-6 binding polypeptide
VDAKYAKEERKAWREIHTLPNLTVQQMAAFISKLFDDPSQSSELLSEAKKLNDSQAPK

SEQ ID NO: 550 - protein, 58 aa, ARTIFICIAL SEQUENCE
  Engineered IL-6 binding polypeptide
VDAKYAKEERHAWLEIHKLPNLTATQMAAFISKLFDDPSQSSELLSEAKKLNDSQAPK

SEQ ID NO: 551 - protein, 58 aa, ARTIFICIAL SEQUENCE
  Engineered IL-6 binding polypeptide
VDAKYAKEEREAWYEIHVLPNLTVEQMVAFIIKLYDDPSQSSELLSEAKKLNDSQAPK

SEQ ID NO: 552 - protein, 58 aa, ARTIFICIAL SEQUENCE
  Engineered IL-6 binding polypeptide
VDAKYAKEERQAWFEIHTLPNLTVDQMVAFISKLFDDPSQSSELLSEAKKLNDSQAPK

SEQ ID NO: 553 - protein, 58 aa, ARTIFICIAL SEQUENCE
  Engineered IL-6 binding polypeptide
VDAKYAKEEARAWYEIHSLPNLTVDQMSAFIIKLYDDPSQSSELLSEAKKLNDSQAPK

SEQ ID NO: 554 - protein, 58 aa, ARTIFICIAL SEQUENCE
  Engineered IL-6 binding polypeptide
VDAKYAKEEAHAWWEIHLLPNLTVHQIAAFISKLFDDPSQSSELLSEAKKLNDSQAPK

SEQ ID NO: 555 - protein, 58 aa, ARTIFICIAL SEQUENCE
  Engineered IL-6 binding polypeptide
VDAKYAKEEAQAWHEIHILPNLTIQQIAAFISKLFDDPSQSSELLSEAKKLNDSQAPK

SEQ ID NO: 556 - protein, 58 aa, ARTIFICIAL SEQUENCE
  Engineered IL-6 binding polypeptide
VDAKYAKEEQDAWWEIHKLPNLTVNQMAAFISKLYDDPSQSSELLSEAKKLNDSQAPK

SEQ ID NO: 557 - protein, 58 aa, ARTIFICIAL SEQUENCE
  Engineered IL-6 binding polypeptide
VDAKYAKEERAAWHEIHLLPNLTISQMAAFISKLFDDPSQSSELLSEAKKLNDSQAPK

SEQ ID NO: 558 - protein, 58 aa, ARTIFICIAL SEQUENCE
  Engineered IL-6 binding polypeptide
VDAKYAKEERQAWFEIHVLPNLTIHQIAAFISKLFDDPSQSSELLSEAKKLNDSQAPK

SEQ ID NO: 559 - protein, 58 aa, ARTIFICIAL SEQUENCE
  Engineered IL-6 binding polypeptide
VDAKYAKEEREAWWEIHALPNLTANQMAAFISKLFDDPSQSSELLSEAKKLNDSQAPK

SEQ ID NO: 560 - protein, 58 aa, ARTIFICIAL SEQUENCE
  Engineered IL-6 binding polypeptide
VDAKYAKEEATAWHEIHLLPNLTITQMAAFISKLFDDPSQSSELLSEAKKLNDSQAPK

SEQ ID NO: 561 - protein, 58 aa, ARTIFICIAL SEQUENCE
  Engineered IL-6 binding polypeptide
VDAKYAKEERKAWYEIHLLPNLTISQMTAFISKLFDDPSQSSELLSEAKKLNDSQAPK

SEQ ID NO: 562 - protein, 58 aa, ARTIFICIAL SEQUENCE
  Engineered IL-6 binding polypeptide
VDAKYAKEEAKAWFEIHALPNLTIQQMAAFISKLFDDPSQSSELLSEAKKLNDSQAPK

SEQ ID NO: 563 - protein, 58 aa, ARTIFICIAL SEQUENCE
  Engineered IL-6 binding polypeptide
VDAKYAKEEARAWHEIHILPNLTTQQMAAFISKLFDDPSQSSELLSEAKKLNDSQAPK

SEQ ID NO: 564 - protein, 58 aa, ARTIFICIAL SEQUENCE
  Engineered IL-6 binding polypeptide
VDAKYAKEEAQAWYEIHLLPNLTVSQIAAFIVKLYDDPSQSSELLSEAKKLNDSQAPK

SEQ ID NO: 565 - protein, 58 aa, ARTIFICIAL SEQUENCE
  Engineered IL-6 binding polypeptide
VDAKYAKEERHAWFEIHKLPNLTVDQVSAFIIKLYDDPSQSSELLSEAKKLNDSQAPK

SEQ ID NO: 566 - protein, 58 aa, ARTIFICIAL SEQUENCE
  Engineered IL-6 binding polypeptide
VDAKYAKEERQAWYEIHVLPNLTVSQMTAFISKLFDDPSQSSELLSEAKKLNDSQAPK

SEQ ID NO: 567 - protein, 58 aa, ARTIFICIAL SEQUENCE
  Engineered IL-6 binding polypeptide
VDAKYAKEEADAWHEIHLLPNLTIDQMAAFISKLFDDPSQSSELLSEAKKLNDSQAPK

SEQ ID NO: 568 - protein, 58 aa, ARTIFICIAL SEQUENCE
  Engineered IL-6 binding polypeptide
VDAKYAKEEASAWREIHILPNLTVNQMAAFISKLFDDPSQSSELLSEAKKLNDSQAPK

SEQ ID NO: 569 - protein, 58 aa, ARTIFICIAL SEQUENCE
  Engineered IL-6 binding polypeptide
VDAKYAKEEAQAWYEIHILPNLTVDQMAAFISKLFDDPSQSSELLSEAKKLNDSQAPK

SEQ ID NO: 570 - protein, 58 aa, ARTIFICIAL SEQUENCE
  Engineered IL-6 binding polypeptide
VDAKYAKEERSAWYEIHILPNLTVHQMTAFISKLFDDPSQSSELLSEAKKLNDSQAPK

SEQ ID NO: 571 - protein, 58 aa, ARTIFICIAL SEQUENCE
  Engineered IL-6 binding polypeptide
VDAKYAKEEATAWREIHLLPNLTVEQMAAFISKLFDDPSQSSELLSEAKKLNDSQAPK

SEQ ID NO: 572 - protein, 58 aa, ARTIFICIAL SEQUENCE
  Engineered IL-6 binding polypeptide
VDAKYAKEERTAWYEIHILPNLTVEQMTAFIQKLFDDPSQSSELLSEAKKLNDSQAPK

SEQ ID NO: 573 - protein, 58 aa, ARTIFICIAL SEQUENCE
  Engineered IL-6 binding polypeptide
VDAKYAKEEAHAWHEIHILPNLTVDQVVAFISKLFDDPSQSSELLSEAKKLNDSQAPK

SEQ ID NO: 574 - protein, 58 aa, ARTIFICIAL SEQUENCE
  Engineered IL-6 binding polypeptide
VDAKYAKEERRAWYEIHLLPNLTVEQMAAFISKLFDDPSQSSELLSEAKKLNDSQAPK

SEQ ID NO: 575 - protein, 58 aa, ARTIFICIAL SEQUENCE
  Engineered IL-6 binding polypeptide
VDAKYAKEERKAWYEIHLLPNLTVSQMTAFISKLFDDPSQSSELLSEAKKLNDSQAPK

SEQ ID NO: 576 - protein, 58 aa, ARTIFICIAL SEQUENCE
  Engineered IL-6 binding polypeptide
VDAKYAKEERRAWFEIHSLPNLTVRQIAAFIIKLFDDPSQSSELLSEAKKLNDSQAPK

SEQ ID NO: 577 - protein, 58 aa, ARTIFICIAL SEQUENCE
  Engineered IL-6 binding polypeptide
VDAKYAKEERQAWTEIHVLPNLTVNQMAAFISKLFDDPSQSSELLSEAKKLNDSQAPK

SEQ ID NO: 578 - protein, 58 aa, ARTIFICIAL SEQUENCE
  Engineered IL-6 binding polypeptide
VDAKYAKEEAHAWYEIHILPNLTIQQMAAFISKLFDDPSQSSELLSEAKKLNDSQAPK

SEQ ID NO: 579 - protein, 58 aa, ARTIFICIAL SEQUENCE
  Engineered IL-6 binding polypeptide
VDAKYAKEERSAWYEIHLLPNLTVDQMTAFIQKLFDDPSQSSELLSEAKKLNDSQAPK

SEQ ID NO: 580 - protein, 58 aa, ARTIFICIAL SEQUENCE
  Engineered IL-6 binding polypeptide
VDAKYAKEERRAWWEIHTLPNLTVDQMVAFISKLFDDPSQSSELLSEAKKLNDSQAPK

SEQ ID NO: 581 - protein, 58 aa, ARTIFICIAL SEQUENCE
  Engineered IL-6 binding polypeptide
VDAKYAKEERAAWFEIHMLPNLTVEQMAAFISKLFDDPSQSSELLSEAKKLNDSQAPK

SEQ ID NO: 582 - protein, 58 aa, ARTIFICIAL SEQUENCE
  Engineered IL-6 binding polypeptide
VDAKYAKEERTAWYEIHALPNLTVDQMVAFISKLFDDPSQSSELLSEAKKLNDSQAPK

SEQ ID NO: 583 - protein, 58 aa, ARTIFICIAL SEQUENCE
  Engineered IL-6 binding polypeptide
VDAKYAKEERQAWWEIHALPNLTVSQMAAFISKLFDDPSQSSELLSEAKKLNDSQAPK

SEQ ID NO: 584 - protein, 58 aa, ARTIFICIAL SEQUENCE
  Engineered IL-6 binding polypeptide
VDAKYAKEERAAWYEIHLLPNLTVEQMAAFISKLFDDPSQSSELLSEAKKLNDSQAPK

SEQ ID NO: 585 - protein, 58 aa, ARTIFICIAL SEQUENCE
  Engineered IL-6 binding polypeptide
VDAKYAKEEQQAWWEIHALPNLTIDQMTAFISKLFDDPSQSSELLSEAKKLNDSQAPK

SEQ ID NO: 586 - protein, 58 aa, ARTIFICIAL SEQUENCE
  Engineered IL-6 binding polypeptide
VDAKYAKEERRAWFEIHSLPNLTVRQMAAFISKLFDDPSQSSELLSEAKKLNDSQAPK

SEQ ID NO: 587 - protein, 58 aa, ARTIFICIAL SEQUENCE
  Engineered IL-6 binding polypeptide
VDAKYAKEERHAWWEIHKLPNLTVDQMAAFISKLFDDPSQSSELLSEAKKLNDSQAPK

SEQ ID NO: 588 - protein, 58 aa, ARTIFICIAL SEQUENCE
  Engineered IL-6 binding polypeptide
VDAKYAKEERKAWWEIHLLPNLTVTQIAAFISKLFDDPSQSSELLSEAKKLNDSQAPK

SEQ ID NO: 589 - protein, 58 aa, ARTIFICIAL SEQUENCE
  Engineered IL-6 binding polypeptide
VDAKYAKEERRAWFEIHSLPNLTVHQMAAFISKLFDDPSQSSELLSEAKKLNDSQAPK

SEQ ID NO: 590 - protein, 58 aa, ARTIFICIAL SEQUENCE
  Engineered IL-6 binding polypeptide
VDAKYAKEEAAAWWEIHMLPNLTVSQMAAFISKLFDDPSQSSELLSEAKKLNDSQAPK

SEQ ID NO: 591 - protein, 58 aa, ARTIFICIAL SEQUENCE
  Engineered IL-6 binding polypeptide
VDAKYAKEEAKAWHEIHLLPNLTVHQMAAFIIKLFDDPSQSSELLSEAKKLNDSQAPK

SEQ ID NO: 592 - protein, 58 aa, ARTIFICIAL SEQUENCE
  Engineered IL-6 binding polypeptide
VDAKYAKEERKAWTEIHLLPNLTVEQMAAFISKLFDDPSQSSELLSEAKKLNDSQAPK

SEQ ID NO: 593 - protein, 58 aa, ARTIFICIAL SEQUENCE
  Engineered IL-6 binding polypeptide
VDAKYAKEEREAWFEIHVLPNLTIRQMAAFISKLFDDPSQSSELLSEAKKLNDSQAPK

SEQ ID NO: 594 - protein, 58 aa, ARTIFICIAL SEQUENCE
  Engineered IL-6 binding polypeptide
VDAKYAKEEREAWYEIHALPNLTVQQMSAFISKLFDDPSQSSELLSEAKKLNDSQAPK

SEQ ID NO: 595 - protein, 58 aa, ARTIFICIAL SEQUENCE
  Engineered IL-6 binding polypeptide
VDAKYAKEERQAWFEIHTLPNLTANQMAAFIIKLYDDPSQSSELLSEAKKLNDSQAPK

SEQ ID NO: 596 - protein, 58 aa, ARTIFICIAL SEQUENCE
  Engineered IL-6 binding polypeptide
VDAKYAKEERHAWYEIHTLPNLTVQQMAAFISKLFDDPSQSSELLSEAKKLNDSQAPK

SEQ ID NO: 597 - protein, 58 aa, ARTIFICIAL SEQUENCE
  Engineered IL-6 binding polypeptide
VDAKYAKEERRAWYEIHLLPNLTVNQMVAFISKLFDDPSQSSELLSEAKKLNDSQAPK

SEQ ID NO: 598 - protein, 58 aa, ARTIFICIAL SEQUENCE
  Engineered IL-6 binding polypeptide
VDAKYAKEERHAWYEIHLLPNLTVEQMAAFISKLFDDPSQSSELLSEAKKLNDSQAPK

SEQ ID NO: 599 - protein, 58 aa, ARTIFICIAL SEQUENCE
  Engineered IL-6 binding polypeptide
VDAKYAKEERKAWYEIHLLPNLTVHQMAAFISKLFDDPSQSSELLSEAKKLNDSQAPK

SEQ ID NO: 600 - protein, 58 aa, ARTIFICIAL SEQUENCE
  Engineered IL-6 binding polypeptide
VDAKYAKEERSAWWEIHTLPNLTVDQMVAFISKLFDDPSQSSELLSEAKKLNDSQAPK

SEQ ID NO: 601 - protein, 58 aa, ARTIFICIAL SEQUENCE
  Engineered IL-6 binding polypeptide
VDAKYAKEEARAWFEIHTLPNLTVDQMAAFISKLFDDPSQSSELLSEAKKLNDSQAPK

SEQ ID NO: 602 - protein, 58 aa, ARTIFICIAL SEQUENCE
  Engineered IL-6 binding polypeptide
VDAKYAKEERRAWYEIHSLPNLTVTQMVAFISKLFDDPSQSSELLSEAKKLNDSQAPK

SEQ ID NO: 603 - protein, 58 aa, ARTIFICIAL SEQUENCE
  Engineered IL-6 binding polypeptide
VDAKYAKEEARAWHEIHVLPNLTVEQMTAFIIKLFDDPSQSSELLSEAKKLNDSQAPK

SEQ ID NO: 604 - protein, 58 aa, ARTIFICIAL SEQUENCE
  Engineered IL-6 binding polypeptide
VDAKYAKEERDAWYEIHLLPNLTIDQMAAFIQKLFDDPSQSSELLSEAKKLNDSQAPK

SEQ ID NO: 605 - protein, 58 aa, ARTIFICIAL SEQUENCE
  Engineered IL-6 binding polypeptide
VDAKYAKEEREAWWEIHLLPNLTIRQMAAFISKLFDDPSQSSELLSEAKKLNDSQAPK

SEQ ID NO: 606 - protein, 58 aa, ARTIFICIAL SEQUENCE
  Engineered IL-6 binding polypeptide
VDAKYAKEEQQAWYEIHLLPNLTVEQMAAFISKLFDDPSQSSELLSEAKKLNDSQAPK

SEQ ID NO: 607 - protein, 58 aa, ARTIFICIAL SEQUENCE
  Engineered IL-6 binding polypeptide
VDAKYAKEERDAWWEIHALPNLTVNQMAAFISKLFDDPSQSSELLSEAKKLNDSQAPK

SEQ ID NO: 608 - protein, 58 aa, ARTIFICIAL SEQUENCE
  Engineered IL-6 binding polypeptide
VDAKYAKEEARAWYEIHILPNLTVTQMAAFIQKLFDDPSQSSELLSEAKKLNDSQAPK

SEQ ID NO: 609 - protein, 58 aa, ARTIFICIAL SEQUENCE
  Engineered IL-6 binding polypeptide
VDAKYAKEERVAWYEIHMLPNLTVSQMAAFISKLFDDPSQSSELLSEAKKLNDSQAPK

SEQ ID NO: 610 - protein, 58 aa, ARTIFICIAL SEQUENCE
  Engineered IL-6 binding polypeptide
VDAKYAKEERTAWWEIHALPNLTVQQRSAFISKLFDDPSQSSELLSEAKKLNDSQAPK

SEQ ID NO: 611 - protein, 58 aa, ARTIFICIAL SEQUENCE
  Engineered IL-6 binding polypeptide
VDAKYAKEEAKAWYEIHLLPNLTVRQMAAFISKLFDDPSQSSELLSEAKKLNDSQAPK

SEQ ID NO: 612 - protein, 58 aa, ARTIFICIAL SEQUENCE
  Engineered IL-6 binding polypeptide
VDAKYAKEERKAWYEIHLLPNLTVRQMAAFIWKLLDDPSQSSELLSEAKKLNDSQAPK

SEQ ID NO: 613 - protein, 58 aa, ARTIFICIAL SEQUENCE
  Engineered IL-6 binding polypeptide
VDAKYAKEERQAWYEIHTLPNLTIDQMSAFISKLFDDPSQSSELLSEAKKLNDSQAPK

SEQ ID NO: 614 - protein, 58 aa, ARTIFICIAL SEQUENCE
  Engineered IL-6 binding polypeptide
VDAKYAKEERKAWWEIHKLPNLTVTQMAAFISKLFDDPSQSSELLSEAKKLNDSQAPK

SEQ ID NO: 615 - protein, 58 aa, ARTIFICIAL SEQUENCE
  Engineered IL-6 binding polypeptide
VDAKYAKEERKAWYEIHALPNLTVEQMAAFIQKLFDDPSQSSELLSEAKKLNDSQAPK

SEQ ID NO: 616 - protein, 58 aa, ARTIFICIAL SEQUENCE
  Engineered IL-6 binding polypeptide
VDAKYAKEEAHAWREIHLLPNLTVQQIAAFISKLFDDPSQSSELLSEAKKLNDSQAPK

SEQ ID NO: 617 - protein, 58 aa, ARTIFICIAL SEQUENCE
  Engineered IL-6 binding polypeptide
VDAKYAKEERHAWHEIHILPNLTVQQMAAFISKLFDDPSQSSELLSEAKKLNDSQAPK

SEQ ID NO: 618 - protein, 58 aa, ARTIFICIAL SEQUENCE
  Engineered IL-6 binding polypeptide
VDAKYAKEERDAWFEIHALPNLTANQMAAFISKLFDDPSQSSELLSEAKKLNDSQAPK

SEQ ID NO: 619 - protein, 58 aa, ARTIFICIAL SEQUENCE
  Engineered IL-6 binding polypeptide
VDAKYAKEEAKAWYEIHLLPNLTVNQMAAFISKLFDDPSQSSELLSEAKKLNDSQAPK

SEQ ID NO: 620 - protein, 58 aa, ARTIFICIAL SEQUENCE
  Engineered IL-6 binding polypeptide
VDAKYAKEERDAWFEIHSLPNLTVSQMAAFIIKLFDDPSQSSELLSEAKKLNDSQAPK

SEQ ID NO: 621 - protein, 58 aa, ARTIFICIAL SEQUENCE
  Engineered IL-6 binding polypeptide
VDAKYAKEERKAWWEIHVLPNLTVDQMAAFISKLFDDPSQSSELLSEAKKLNDSQAPK

SEQ ID NO: 622 - protein, 58 aa, ARTIFICIAL SEQUENCE
  Engineered IL-6 binding polypeptide
VDAKYAKEEAHAWYEIHTLPNLTVRQMAAFISKLFDDPSQSSELLSEAKKLNDSQAPK

SEQ ID NO: 623 - protein, 58 aa, ARTIFICIAL SEQUENCE
  Engineered IL-6 binding polypeptide
VDAKYAKEEARAWREIHTLPNLTVNQMAAFISKLFDDPSQSSELLSEAKKLNDSQAPK

SEQ ID NO: 624 - protein, 58 aa, ARTIFICIAL SEQUENCE
  Engineered IL-6 binding polypeptide
VDAKYAKEERRAWTEIHLLPNLTVEQMAAFISKLFDDPSQSSELLSEAKKLNDSQAPK

SEQ ID NO: 625 - protein, 58 aa, ARTIFICIAL SEQUENCE
  Engineered IL-6 binding polypeptide
VDAKYAKEEAHAWHEIHTLPNLTIDQMVAFISKLFDDPSQSSELLSEAKKLNDSQAPK

SEQ ID NO: 626 - protein, 58 aa, ARTIFICIAL SEQUENCE
  Engineered IL-6 binding polypeptide
VDAKYAKEERQAWYEIHLLPNLTVHQMAAFISKLFDDPSQSSELLSEAKKLNDSQAPK

SEQ ID NO: 627 - protein, 58 aa, ARTIFICIAL SEQUENCE
  Engineered IL-6 binding polypeptide
VDAKYAKEERRAWWEIHLLPNLTVRQMAAFISKLFDDPSQSSELLSEAKKLNDSQAPK

SEQ ID NO: 628 - protein, 58 aa, ARTIFICIAL SEQUENCE
  Engineered IL-6 binding polypeptide
VDAKYAKEEAHAWTEIHKLPNLTVDQMTAFIIKLYDDPSQSSELLSEAKKLNDSQAPK

SEQ ID NO: 629 - protein, 58 aa, ARTIFICIAL SEQUENCE
  Engineered IL-6 binding polypeptide
VDAKYAKEEARAWREIHLLPNLTVTQMAAFISKLFDDPSQSSELLSEAKKLNDSQAPK

SEQ ID NO: 630 - protein, 58 aa, ARTIFICIAL SEQUENCE
  Engineered IL-6 binding polypeptide
VDAKYAKEERQAWWEIHSLPNLTIEQMVAFISKLFDDPSQSSELLSEAKKLNDSQAPK

SEQ ID NO: 631 - protein, 58 aa, ARTIFICIAL SEQUENCE
  Engineered IL-6 binding polypeptide
VDAKYAKEERDAWYEIHLLPNLTIQQMAAFIQKLFDDPSQSSELLSEAKKLNDSQAPK

SEQ ID NO: 632 - protein, 58 aa, ARTIFICIAL SEQUENCE
  Engineered IL-6 binding polypeptide
VDAKYAKEERTAWWEIHKLPNLTVTQMAAFISKLFDDPSQSSELLSEAKKLNDSQAPK

SEQ ID NO: 633 - protein, 58 aa, ARTIFICIAL SEQUENCE
  Engineered IL-6 binding polypeptide
VDAKYAKEERDAWYEIHILPNLTIEQMAAFISKLFDDPSQSSELLSEAKKLNDSQAPK

SEQ ID NO: 634 - protein, 58 aa, ARTIFICIAL SEQUENCE
  Engineered IL-6 binding polypeptide
VDAKYAKEEREAWWEIHSLPNLTAHQMAAFIIKLFDDPSQSSELLSEAKKLNDSQAPK

SEQ ID NO: 635 - protein, 58 aa, ARTIFICIAL SEQUENCE
  Engineered IL-6 binding polypeptide
VDAKYAKEERKAWYEIHSLPNLTVSQMSAFISKLFDDPSQSSELLSEAKKLNDSQAPK

SEQ ID NO: 636 - protein, 58 aa, ARTIFICIAL SEQUENCE
  Engineered IL-6 binding polypeptide
VDAKYAKEERHAWFEIHALPNLTVSQMVAFISKLFDDPSQSSELLSEAKKLNDSQAPK

SEQ ID NO: 637 - protein, 58 aa, ARTIFICIAL SEQUENCE
  Engineered IL-6 binding polypeptide
VDAKYAKEERHAWREIHLLPNLTTEQMSAFIQKLFDDPSQSSELLSEAKKLNDSQAPK

SEQ ID NO: 638 - protein, 58 aa, ARTIFICIAL SEQUENCE
  Engineered IL-6 binding polypeptide
VDAKYAKEEHRAWTEIHTLPNLTVDQMAAFIIKLFDDPSQSSELLSEAKKLNDSQAPK

SEQ ID NO: 639 - protein, 58 aa, ARTIFICIAL SEQUENCE
  Engineered IL-6 binding polypeptide
VDAKYAKEERDAWYEIHLLPNLTTQQRAAFIVKLFDDPSQSSELLSEAKKLNDSQAPK

SEQ ID NO: 640 - protein, 58 aa, ARTIFICIAL SEQUENCE
  Engineered IL-6 binding polypeptide
VDAKYAKEEAQAWWEIHALPNLTVSQMVAFIMKLFDDPSQSSELLSEAKKLNDSQAPK

SEQ ID NO: 641 - protein, 58 aa, ARTIFICIAL SEQUENCE
  Engineered IL-6 binding polypeptide
VDAKYAKEEREAWWEIHALPNLTVNQVVAFISKLFDDPSQSSELLSEAKKLNDSQAPK

SEQ ID NO: 642 - protein, 58 aa, ARTIFICIAL SEQUENCE
  Engineered IL-6 binding polypeptide
VDAKYAKEERQAWYEIHVLPNLTVNQMAAFISKLFDDPSQSSELLSEAKKLNDSQAPK

SEQ ID NO: 643 - protein, 58 aa, ARTIFICIAL SEQUENCE
  Engineered IL-6 binding polypeptide
VDAKYAKEERSAWYEIHLLPNLTVHQMTAFISKLFDDPSQSSELLSEAKKLNDSQAPK

SEQ ID NO: 644 - protein, 58 aa, ARTIFICIAL SEQUENCE
  Engineered IL-6 binding polypeptide
VDAKYAKEEAKAWYEIHILPNLTVHQIAAFIQKLFDDPSQSSELLSEAKKLNDSQAPK

SEQ ID NO: 645 - protein, 58 aa, ARTIFICIAL SEQUENCE
  Engineered IL-6 binding polypeptide
VDAKYAKEEQQAWLEIHTLPNLTVSQMAAFISKLFDDPSQSSELLSEAKKLNDSQAPK

SEQ ID NO: 646 - protein, 58 aa, ARTIFICIAL SEQUENCE
  Engineered IL-6 binding polypeptide
VDAKYAKEEAHAWREIHLLPNLTVTQMAAFISKLFDDPSQSSELLSEAKKLNDSQAPK

SEQ ID NO: 647 - protein, 58 aa, ARTIFICIAL SEQUENCE
  Engineered IL-6 binding polypeptide
VDAKYAKEERAAWFEIHLLPNLTIHQMAAFISKLFDDPSQSSELLSEAKKLNDSQAPK

SEQ ID NO: 648 - protein, 58 aa, ARTIFICIAL SEQUENCE
  Engineered IL-6 binding polypeptide
VDAKYAKEEQQAWYEIHILPNLTVSQMAAFISKLFDDPSQSSELLSEAKKLNDSQAPK

SEQ ID NO: 649 - protein, 58 aa, ARTIFICIAL SEQUENCE
  Engineered IL-6 binding polypeptide
VDAKYAKEERDAWYEIHTLPNLTINQMAAFISKLFDDPSQSSELLSEAKKLNDSQAPK

SEQ ID NO: 650 - protein, 58 aa, ARTIFICIAL SEQUENCE
  Engineered IL-6 binding polypeptide
VDAKYAKEEAHAWYEIHILPNLTVNQITAFISKLFDDPSQSSELLSEAKKLNDSQAPK

SEQ ID NO: 651 - protein, 58 aa, ARTIFICIAL SEQUENCE
  Engineered IL-6 binding polypeptide
VDAKYAKEERRAWWEIHALPNLTVSQMVAFISKLFDDPSQSSELLSEAKKLNDSQAPK

SEQ ID NO: 652 - protein, 58 aa, ARTIFICIAL SEQUENCE
  Engineered IL-6 binding polypeptide
VDAKYAKEEAQAWYEIHTLPNLTVHQMAAFISKLFDDPSQSSELLSEAKKLNDSQAPK

SEQ ID NO: 653 - protein, 58 aa, ARTIFICIAL SEQUENCE
  Engineered IL-6 binding polypeptide
VDAKYAKEERAAWFEIHKLPNLTVEQMTAFIHKLYDDPSQSSELLSEAKKLNDSQAPK

SEQ ID NO: 654 - protein, 58 aa, ARTIFICIAL SEQUENCE
  Engineered IL-6 binding polypeptide
VDAKYAKEEAHAWREIHLLPNLTITQMAAFIQKLFDDPSQSSELLSEAKKLNDSQAPK

SEQ ID NO: 655 - protein, 58 aa, ARTIFICIAL SEQUENCE
  Engineered IL-6 binding polypeptide
VDAKYAKEEARAWHEIHVLPNLTVTQVVAFISKLFDDPSQSSELLSEAKKLNDSQAPK

SEQ ID NO: 656 - protein, 58 aa, ARTIFICIAL SEQUENCE
  Engineered IL-6 binding polypeptide
VDAKYAKEEAKAWHEIHVLPNLTVSQIAAFISKLFDDPSQSSELLSEAKKLNDSQAPK

SEQ ID NO: 657 - protein, 58 aa, ARTIFICIAL SEQUENCE
  Engineered IL-6 binding polypeptide
VDAKYAKEEHRAWYEIHLLPNLTINQMAAFISKLFDDPSQSSELLSEAKKLNDSQAPK

SEQ ID NO: 658 - protein, 58 aa, ARTIFICIAL SEQUENCE
  Engineered IL-6 binding polypeptide
VDAKYAKEEAHAWTEIHKLPNLTTQQMAAFIQKLFDDPSQSSELLSEAKKLNDSQAPK

SEQ ID NO: 659 - protein, 58 aa, ARTIFICIAL SEQUENCE
  Engineered IL-6 binding polypeptide
VDAKYAKEERTAWYEIHLLPNLTVRQMVAFISKLFDDPSQSSELLSEAKKLNDSQAPK

SEQ ID NO: 660 - protein, 58 aa, ARTIFICIAL SEQUENCE
  Engineered IL-6 binding polypeptide
VDAKYAKEERKAWYEIHLLPNLTIQQIAAFISKLFDDPSQSSELLSEAKKLNDSQAPK

SEQ ID NO: 661 - protein, 58 aa, ARTIFICIAL SEQUENCE
  Engineered IL-6 binding polypeptide
VDAKYAKEEREAWHEIHLLPNLTVTQMAAFIIKLFDDPSQSSELLSEAKKLNDSQAPK

SEQ ID NO: 662 - protein, 58 aa, ARTIFICIAL SEQUENCE
  Engineered IL-6 binding polypeptide
VDAKYAKEEARAWWEIHLLPNLTVEQMAAFISKLFDDPSQSSELLSEAKKLNDSQAPK

SEQ ID NO: 663 - protein, 58 aa, ARTIFICIAL SEQUENCE
  Engineered IL-6 binding polypeptide
VDAKYAKEERQAWWEIHILPNLTVTQMAAFISKLFDDPSQSSELLSEAKKLNDSQAPK

SEQ ID NO: 664 - protein, 58 aa, ARTIFICIAL SEQUENCE
  Engineered IL-6 binding polypeptide
VDAKYAKEEAQAWREIHTLPNLTANQMAAFIIKLYDDPSQSSELLSEAKKLNDSQAPK

SEQ ID NO: 665 - protein, 58 aa, ARTIFICIAL SEQUENCE
  Engineered IL-6 binding polypeptide
VDAKYAKEERHAWTEIHLLPNLTISQMAAFISKLFDDPSQSSELLSEAKKLNDSQAPK

SEQ ID NO: 666 - protein, 58 aa, ARTIFICIAL SEQUENCE
  Engineered IL-6 binding polypeptide
VDAKYAKEEARAWWEIHMLPNLTVTQMAAFISKLFDDPSQSSELLSEAKKLNDSQAPK

SEQ ID NO: 667 - protein, 58 aa, ARTIFICIAL SEQUENCE
  Engineered IL-6 binding polypeptide
VDAKYAKEEREAWWEIHLLPNLTAEQMAAFISKLFDDPSQSSELLSEAKKLNDSQAPK

SEQ ID NO: 668 - protein, 58 aa, ARTIFICIAL SEQUENCE
  Engineered IL-6 binding polypeptide
VDAKYAKEEATAWWEIHLLPNLTVTQMAAFIQKLFDDPSQSSELLSEAKKLNDSQAPK

SEQ ID NO: 669 - protein, 58 aa, ARTIFICIAL SEQUENCE
  Engineered IL-6 binding polypeptide
VDAKYAKEEAKAWHEIHLLPNLTVNQMAAFISKLFDDPSQSSELLSEAKKLNDSQAPK

SEQ ID NO: 670 - protein, 58 aa, ARTIFICIAL SEQUENCE
  Engineered IL-6 binding polypeptide
VDAKYAKEERRAWYEIHLLPNLTITQMTAFISKLFDDPSQSSELLSEAKKLNDSQAPK

SEQ ID NO: 671 - protein, 58 aa, ARTIFICIAL SEQUENCE
  Engineered IL-6 binding polypeptide
VDAKYAKEERRAWYEIHLLPNLTVHQIAAFISKLFDDPSQSSELLSEAKKLNDSQAPK

SEQ ID NO: 672 - protein, 58 aa, ARTIFICIAL SEQUENCE
  Engineered IL-6 binding polypeptide
VDAKYAKEEHEAWWEIHLLPNLTVTQMAAFISKLFDDPSQSSELLSEAKKLNDSQAPK

SEQ ID NO: 673 - protein, 58 aa, ARTIFICIAL SEQUENCE
  Engineered IL-6 binding polypeptide
VDAKYAKEERKAWTEIHSLPNLTVDQMSAFIIKLFDDPSQSSELLSEAKKLNDSQAPK

SEQ ID NO: 674 - protein, 58 aa, ARTIFICIAL SEQUENCE
  Engineered IL-6 binding polypeptide
VDAKYAKEEAKAWFEIHLLPNLTINQMAAFISKLFDDPSQSSELLSEAKKLNDSQAPK

SEQ ID NO: 675 - protein, 58 aa, ARTIFICIAL SEQUENCE
  Engineered IL-6 binding polypeptide
VDAKYAKEERDAWYEIHVLPNLTIEQMSAFISKLFDDPSQSSELLSEAKKLNDSQAPK

SEQ ID NO: 676 - protein, 58 aa, ARTIFICIAL SEQUENCE
  Engineered IL-6 binding polypeptide
VDAKYAKEEAHAWWEIHALPNLTVTQMAAFISKLFDDPSQSSELLSEAKKLNDSQAPK

SEQ ID NO: 677 - protein, 58 aa, ARTIFICIAL SEQUENCE
  Engineered IL-6 binding polypeptide
VDAKYAKEEAKAWYEIHLLPNLTVTQMAAFISKLFDDPSQSSELLSEAKKLNDSQAPK

SEQ ID NO: 678 - protein, 58 aa, ARTIFICIAL SEQUENCE
  Engineered IL-6 binding polypeptide
VDAKYAKEERDAWWEIHKLPNLTVSQMAAFISKLFDDPSQSSELLSEAKKLNDSQAPK

SEQ ID NO: 679 - protein, 58 aa, ARTIFICIAL SEQUENCE
  Engineered IL-6 binding polypeptide
VDAKYAKEERDAWYEIHLLPNLTVRQMAAFISKLFDDPSQSSELLSEAKKLNDSQAPK

SEQ ID NO: 680 - protein, 58 aa, ARTIFICIAL SEQUENCE
  Engineered IL-6 binding polypeptide
VDAKYAKEERAAWWEIHLLPNLTVQQMAAFISKLFDDPSQSSELLSEAKKLNDSQAPK

SEQ ID NO: 681 - protein, 58 aa, ARTIFICIAL SEQUENCE
  Engineered IL-6 binding polypeptide
VDAKYAKEEQQAWYEIHLLPNLTVTQMAAFIIKLFDDPSQSSELLSEAKKLNDSQAPK

SEQ ID NO: 682 - protein, 58 aa, ARTIFICIAL SEQUENCE
  Engineered IL-6 binding polypeptide
VDAKYAKEEADAWFEIHILPNLTIDQMAAFIQKLFDDPSQSSELLSEAKKLNDSQAPK

SEQ ID NO: 683 - protein, 58 aa, ARTIFICIAL SEQUENCE
  Engineered IL-6 binding polypeptide
VDAKYAKEEREAWHEIHTLPNLTVDQMAAFISKLFDDPSQSSELLSEAKKLNDSQAPK

SEQ ID NO: 684 - protein, 58 aa, ARTIFICIAL SEQUENCE
  Engineered IL-6 binding polypeptide
VDAKYAKEEATAWFEIHTLPNLTVSQMAAFIWKLFDDPSQSSELLSEAKKLNDSQAPK

SEQ ID NO: 685 - protein, 58 aa, ARTIFICIAL SEQUENCE
  Engineered IL-6 binding polypeptide
VDAKYAKEEAAAWHEIHILPNLTHHQMAAFIQKLFDDPSQSSELLSEAKKLNDSQAPK

SEQ ID NO: 686 - protein, 58 aa, ARTIFICIAL SEQUENCE
  Engineered IL-6 binding polypeptide
VDAKYAKEERDAWFEIHALPNLTVNQMAAFIIKLYDDPSQSSELLSEAKKLNDSQAPK

SEQ ID NO: 687 - protein, 58 aa, ARTIFICIAL SEQUENCE
  Engineered IL-6 binding polypeptide
VDAKYAKEERKAWYEIHLLPNLTTSQHAAFISKLFDDPSQSSELLSEAKKLNDSQAPK

SEQ ID NO: 688 - protein, 58 aa, ARTIFICIAL SEQUENCE
  Engineered IL-6 binding polypeptide
VDAKYAKEERDAWYEIHLLPNLTVRQMSAFIIKLFDDPSQSSELLSEAKKLNDSQAPK

SEQ ID NO: 689 - protein, 58 aa, ARTIFICIAL SEQUENCE
  Engineered IL-6 binding polypeptide
VDAKYAKEEAVAWHEIHALPNLTVDQMSAFISKLFDDPSQSSELLSEAKKLNDSQAPK

SEQ ID NO: 690 - protein, 58 aa, ARTIFICIAL SEQUENCE
  Engineered IL-6 binding polypeptide
VDAKYAKEEAKAWFEIHALPNLTIEQMVAFISKLFDDPSQSSELLSEAKKLNDSQAPK

SEQ ID NO: 691 - protein, 58 aa, ARTIFICIAL SEQUENCE
  Engineered IL-6 binding polypeptide
VDAKYAKEEADAWHEIHILPNLTVQQMAAFIQKLFDDPSQSSELLSEAKKLNDSQAPK

SEQ ID NO: 692 - protein, 58 aa, ARTIFICIAL SEQUENCE
  Engineered IL-6 binding polypeptide
VDAKYAKEEAAAWWEIHSLPNLTVSQMAAFIWKLFDDPSQSSELLSEAKKLNDSQAPK

SEQ ID NO: 693 - protein, 58 aa, ARTIFICIAL SEQUENCE
  Engineered IL-6 binding polypeptide
VDAKYAKEEAKAWHEIHTLPNLTVDQMAAFISKLFDDPSQSSELLSEAKKLNDSQAPK

SEQ ID NO: 694 - protein, 58 aa, ARTIFICIAL SEQUENCE
  Engineered IL-6 binding polypeptide
VDAKYAKEEAQAWWEIHILPNLTVNQIAAFISKLFDDPSQSSELLSEAKKLNDSQAPK

SEQ ID NO: 695 - protein, 58 aa, ARTIFICIAL SEQUENCE
  Engineered IL-6 binding polypeptide
VDAKYAKEERSAWFEIHVLPNLTIRQMSAFISKLFDDPSQSSELLSEAKKLNDSQAPK

SEQ ID NO: 696 - protein, 58 aa, ARTIFICIAL SEQUENCE
  Engineered IL-6 binding polypeptide
VDAKYAKEERRAWLEIHLLPNLTVTQMTAFISKLFDDPSQSSELLSEAKKLNDSQAPK

SEQ ID NO: 697 - protein, 58 aa, ARTIFICIAL SEQUENCE
  Engineered IL-6 binding polypeptide
VDAKYAKEERAAWFEIHLLPNLTATQIAAFISKLFDDPSQSSELLSEAKKLNDSQAPK

SEQ ID NO: 698 - protein, 58 aa, ARTIFICIAL SEQUENCE
  Engineered IL-6 binding polypeptide
VDAKYAKEERAAWHEIHVLPNLTVDQMAAFISKLFDDPSQSSELLSEAKKLNDSQAPK

SEQ ID NO: 699 - protein, 58 aa, ARTIFICIAL SEQUENCE
  Engineered IL-6 binding polypeptide
VDAKYAKEEARAWYEIHTLPNLTIHQMAAFISKLFDDPSQSSELLSEAKKLNDSQAPK

SEQ ID NO: 700 - protein, 58 aa, ARTIFICIAL SEQUENCE
  Engineered IL-6 binding polypeptide
VDAKYAKEEAEAWFEIHALPNLTVHQMAAFIQKLFDDPSQSSELLSEAKKLNDSQAPK

SEQ ID NO: 701 - protein, 58 aa, ARTIFICIAL SEQUENCE
  Engineered IL-6 binding polypeptide
VDAKYAKEERAAWYEIHSLPNLTTNQMAAFISKLFDDPSQSSELLSEAKKLNDSQAPK

SEQ ID NO: 702 - protein, 58 aa, ARTIFICIAL SEQUENCE
  Engineered IL-6 binding polypeptide
VDAKYAKEEAKAWHEIHVLPNLTIEQRAAFISKLFDDPSQSSELLSEAKKLNDSQAPK

SEQ ID NO: 703 - protein, 58 aa, ARTIFICIAL SEQUENCE
  Engineered IL-6 binding polypeptide
VDAKYAKEERTAWYEIHVLPNLTATQMAAFISKLFDDPSQSSELLSEAKKLNDSQAPK

SEQ ID NO: 704 - protein, 58 aa, ARTIFICIAL SEQUENCE
  Engineered IL-6 binding polypeptide
VDAKYAKEERRAWWEIHLLPNLTVDQMSAFISKLFDDPSQSSELLSEAKKLNDSQAPK

SEQ ID NO: 705 - protein, 58 aa, ARTIFICIAL SEQUENCE
  Engineered IL-6 binding polypeptide
VDAKYAKEEADAWREIHLLPNLTVTQTAAFISKLFDDPSQSSELLSEAKKLNDSQAPK

SEQ ID NO: 706 - protein, 58 aa, ARTIFICIAL SEQUENCE
  Engineered IL-6 binding polypeptide
VDAKYAKEERDAWFEIHVLPNLTTEQMVAFISKLFDDPSQSSELLSEAKKLNDSQAPK

SEQ ID NO: 707 - protein, 58 aa, ARTIFICIAL SEQUENCE
  Engineered IL-6 binding polypeptide
VDAKYAKEEQQAWYEIHVLPNLTVSQMAAFISKLFDDPSQSSELLSEAKKLNDSQAPK

SEQ ID NO: 708 - protein, 58 aa, ARTIFICIAL SEQUENCE
  Engineered IL-6 binding polypeptide
VDAKYAKEERRAWFEIHALPNLTVNQMVAFISKLFDDPSQSSELLSEAKKLNDSQAPK

SEQ ID NO: 709 - protein, 58 aa, ARTIFICIAL SEQUENCE
  Engineered IL-6 binding polypeptide
VDAKYAKEERKAWFEIHSLPNLTATQMHAFISKLFDDPSQSSELLSEAKKLNDSQAPK

SEQ ID NO: 710 - protein, 58 aa, ARTIFICIAL SEQUENCE
  Engineered IL-6 binding polypeptide
VDAKYAKEEQQAWLEIHLLPNLTVEQMTAFIHKLYDDPSQSSELLSEAKKLNDSQAPK

SEQ ID NO: 711 - protein, 58 aa, ARTIFICIAL SEQUENCE
  Engineered IL-6 binding polypeptide
VDAKYAKEEAEAWLEIHLLPNLTVHQMAAFISKLFDDPSQSSELLSEAKKLNDSQAPK

SEQ ID NO: 712 - protein, 58 aa, ARTIFICIAL SEQUENCE
  Engineered IL-6 binding polypeptide
VDAKYAKEERDAWHEIHLLPNLTINQMTAFISKLFDDPSQSSELLSEAKKLNDSQAPK

SEQ ID NO: 713 - protein, 58 aa, ARTIFICIAL SEQUENCE
  Engineered IL-6 binding polypeptide
VDAKYAKEERRAWYEIHILPNLTVHQMTAFIQKLLDDPSQSSELLSEAKKLNDSQAPK

SEQ ID NO: 714 - protein, 58 aa, ARTIFICIAL SEQUENCE
  Engineered IL-6 binding polypeptide
VDAKYAKEEARAWHEIHLLPNLTVDQTTAFISKLFDDPSQSSELLSEAKKLNDSQAPK

SEQ ID NO: 715 - protein, 58 aa, ARTIFICIAL SEQUENCE
  Engineered IL-6 binding polypeptide
VDAKYAKEERQAWREIHTLPNLTVHQMAAFISKLFDDPSQSSELLSEAKKLNDSQAPK

SEQ ID NO: 716 - protein, 58 aa, ARTIFICIAL SEQUENCE
  Engineered IL-6 binding polypeptide
VDAKYAKEEHDAWREIHTLPNLTVSQMAAFISKLFDDPSQSSELLSEAKKLNDSQAPK

SEQ ID NO: 717 - protein, 58 aa, ARTIFICIAL SEQUENCE
  Engineered IL-6 binding polypeptide
VDAKYAKEERAAWWEIHTLPNLTVHQMAAFISKLFDDPSQSSELLSEAKKLNDSQAPK

SEQ ID NO: 718 - protein, 58 aa, ARTIFICIAL SEQUENCE
  Engineered IL-6 binding polypeptide
VDAKYAKEEAKAWHEIHALPNLTVSQMAAFISKLFDDPSQSSELLSEAKKLNDSQAPK

SEQ ID NO: 719 - protein, 58 aa, ARTIFICIAL SEQUENCE
  Engineered IL-6 binding polypeptide
VDAKYAKEEAAAWWEIHTLPNLTVDQMAAFISKLFDDPSQSSELLSEAKKLNDSQAPK

SEQ ID NO: 720 - protein, 58 aa, ARTIFICIAL SEQUENCE
  Engineered IL-6 binding polypeptide
VDAKYAKEERQAWFEIHKLPNLTVNQMAAFISKLFDDPSQSSELLSEAKKLNDSQAPK

SEQ ID NO: 721 - protein, 58 aa, ARTIFICIAL SEQUENCE
  Engineered IL-6 binding polypeptide
VDAKYAKEERSAWREIHVLPNLTVNQRAAFISKLFDDPSQSSELLSEAKKLNDSQAPK

SEQ ID NO: 722 - protein, 58 aa, ARTIFICIAL SEQUENCE
  Engineered IL-6 binding polypeptide
VDAKYAKEEAAAWHEIHLLPNLTVTQIAAFISKLFDDPSQSSELLSEAKKLNDSQAPK

SEQ ID NO: 723 - protein, 58 aa, ARTIFICIAL SEQUENCE
  Engineered IL-6 binding polypeptide
VDAKYAKEEREAWAEIHKLPNLTATQMHAFISKLFDDPSQSSELLSEAKKLNDSQAPK

SEQ ID NO: 724 - protein, 58 aa, ARTIFICIAL SEQUENCE
  Engineered IL-6 binding polypeptide
VDAKYAKEEQRAWSEIHSLPNLTVNQMAAFIMKLYDDPSQSSELLSEAKKLNDSQAPK

SEQ ID NO: 725 - protein, 58 aa, ARTIFICIAL SEQUENCE
  Engineered IL-6 binding polypeptide
VDAKYAKEEAKAWWEIHVLPNLTIDQITAFIHKLYDDPSQSSELLSEAKKLNDSQAPK

SEQ ID NO: 726 - protein, 58 aa, ARTIFICIAL SEQUENCE
  Engineered IL-6 binding polypeptide
VDAKYAKEEAQAWWEIHTLPNLTVDQMAAFISKLFDDPSQSSELLSEAKKLNDSQAPK

SEQ ID NO: 727 - protein, 58 aa, ARTIFICIAL SEQUENCE
  Engineered IL-6 binding polypeptide
VDAKYAKEERRAWHEIHILPNLTTSQMAAFIQKLFDDPSQSSELLSEAKKLNDSQAPK

SEQ ID NO: 728 - protein, 58 aa, ARTIFICIAL SEQUENCE
  Engineered IL-6 binding polypeptide
VDAKYAKEERSAWYEIHTLPNLTTNQRTAFISKLFDDPSQSSELLSEAKKLNDSQAPK

SEQ ID NO: 729 - protein, 58 aa, ARTIFICIAL SEQUENCE
  Engineered IL-6 binding polypeptide
VDAKYAKEERRAWFEIHMLPNLTIDQMAAFISKLFDDPSQSSELLSEAKKLNDSQAPK

SEQ ID NO: 730 - protein, 58 aa, ARTIFICIAL SEQUENCE
  Engineered IL-6 binding polypeptide
VDAKYAKEEAKAWYEIHALPNLTVDQMVAFITKLFDDPSQSSELLSEAKKLNDSQAPK

SEQ ID NO: 731 - protein, 58 aa, ARTIFICIAL SEQUENCE
  Engineered IL-6 binding polypeptide
VDAKYAKEEHVAWLEIHLLPNLTAEQMAAFISKLYDDPSQSSELLSEAKKLNDSQAPK

SEQ ID NO: 732 - protein, 58 aa, ARTIFICIAL SEQUENCE
  Engineered IL-6 binding polypeptide
VDAKYAKEERDAWFEIHALPNLTVQQMAAFISKLFDDPSQSSELLSEAKKLNDSQAPK

SEQ ID NO: 733 - protein, 58 aa, ARTIFICIAL SEQUENCE
  Engineered IL-6 binding polypeptide
VDAKYAKEEARAWREIHLLPNLTVDQMAAFISKLFDDPSQSSELLSEAKKLNDSQAPK

SEQ ID NO: 734 - protein, 58 aa, ARTIFICIAL SEQUENCE
  Engineered IL-6 binding polypeptide
VDAKYAKEEARAWWEIHMLPNLTINQMAAFISKLFDDPSQSSELLSEAKKLNDSQAPK

SEQ ID NO: 735 - protein, 58 aa, ARTIFICIAL SEQUENCE
  Engineered IL-6 binding polypeptide
VDAKYAKEEAAAWLEIHKLPNLTVHQMAAFISKLFDDPSQSSELLSEAKKLNDSQAPK

SEQ ID NO: 736 - protein, 58 aa, ARTIFICIAL SEQUENCE
  Engineered IL-6 binding polypeptide
VDAKYAKEERQAWFEIHVLPNLTTDQMAAFIHKLYDDPSQSSELLSEAKKLNDSQAPK

SEQ ID NO: 737 - protein, 58 aa, ARTIFICIAL SEQUENCE
  Engineered IL-6 binding polypeptide
VDAKYAKEEQRAWTEIHLLPNLTVNQMAAFISKLFDDPSQSSELLSEAKKLNDSQAPK

SEQ ID NO: 738 - protein, 58 aa, ARTIFICIAL SEQUENCE
  Engineered IL-6 binding polypeptide
VDAKYAKEEQQAWYEIHTLPNLTVQQMAAFIQKLFDDPSQSSELLSEAKKLNDSQAPK

SEQ ID NO: 739 - protein, 58 aa, ARTIFICIAL SEQUENCE
  Engineered IL-6 binding polypeptide
VDAKYAKEEQHAWREIHILPNLTVTQIAAFISKLFDDPSQSSELLSEAKKLNDSQAPK

SEQ ID NO: 740 - protein, 58 aa, ARTIFICIAL SEQUENCE
  Engineered IL-6 binding polypeptide
VDAKYAKEEQRAWYEIHLLPNLTVTQMAAFISKLFDDPSQSSELLSEAKKLNDSQAPK

SEQ ID NO: 741 - protein, 58 aa, ARTIFICIAL SEQUENCE
  Engineered IL-6 binding polypeptide
VDAKYAKEERAAWFEIHSLPNLTVSQMAAFISKLFDDPSQSSELLSEAKKLNDSQAPK

SEQ ID NO: 742 - protein, 58 aa, ARTIFICIAL SEQUENCE
  Engineered IL-6 binding polypeptide
VDAKYAKEERQAWYEIHILPNLTAEQMAAFISKLFDDPSQSSELLSEAKKLNDSQAPK

SEQ ID NO: 743 - protein, 58 aa, ARTIFICIAL SEQUENCE
  Engineered IL-6 binding polypeptide
VDAKYAKEEAQAWWEIHVLPNLTVRQIVAFISKLFDDPSQSSELLSEAKKLNDSQAPK

SEQ ID NO: 744 - protein, 58 aa, ARTIFICIAL SEQUENCE
  Engineered IL-6 binding polypeptide
VDAKYAKEERRAWFEIHTLPNLTVHQMTAFIQKLFDDPSQSSELLSEAKKLNDSQAPK

SEQ ID NO: 745 - protein, 58 aa, ARTIFICIAL SEQUENCE
  Engineered IL-6 binding polypeptide
VDAKYAKEEQRAWHEIHLLPNLTTRQMAAFISKLFDDPSQSSELLSEAKKLNDSQAPK

SEQ ID NO: 746 - protein, 58 aa, ARTIFICIAL SEQUENCE
  Engineered IL-6 binding polypeptide
VDAKYAKEERHAWHEIHILPNLTIEQMVAFISKLFDDPSQSSELLSEAKKLNDSQAPK

SEQ ID NO: 747 - protein, 58 aa, ARTIFICIAL SEQUENCE
  Engineered IL-6 binding polypeptide
VDAKYAKEERQAWFEIHALPNLTVQQVEAFISKLFDDPSQSSELLSEAKKLNDSQAPK

SEQ ID NO: 748 - protein, 58 aa, ARTIFICIAL SEQUENCE
  Engineered IL-6 binding polypeptide
VDAKYAKEEQRAWREIHLLPNLTVTQMAAFISKLFDDPSQSSELLSEAKKLNDSQAPK

SEQ ID NO: 749 - protein, 58 aa, ARTIFICIAL SEQUENCE
  Engineered IL-6 binding polypeptide
VDAKYAKEERHAWWEIHSLPNLTISQMAAFISKLFDDPSQSSELLSEAKKLNDSQAPK

SEQ ID NO: 750 - protein, 58 aa, ARTIFICIAL SEQUENCE
  Engineered IL-6 binding polypeptide
VDAKYAKEEARAWLEIHALPNLTVDQMAAFISKLFDDPSQSSELLSEAKKLNDSQAPK

SEQ ID NO: 751 - protein, 58 aa, ARTIFICIAL SEQUENCE
  Engineered IL-6 binding polypeptide
VDAKYAKEEQRAWHEIHTLPNLTVRQMAAFIIKLFDDPSQSSELLSEAKKLNDSQAPK

SEQ ID NO: 752 - protein, 58 aa, ARTIFICIAL SEQUENCE
  Engineered IL-6 binding polypeptide
VDAKYAKEERHAWFEIHKLPNLTVEQMAAFIWKLFDDPSQSSELLSEAKKLNDSQAPK

SEQ ID NO: 753 - protein, 58 aa, ARTIFICIAL SEQUENCE
  Engineered IL-6 binding polypeptide
VDAKYAKEERDAWYEIHLLPNLTINQIAAFISKLFDDPSQSSELLSEAKKLNDSQAPK

SEQ ID NO: 754 - protein, 58 aa, ARTIFICIAL SEQUENCE
  Engineered IL-6 binding polypeptide
VDAKYAKEERQAWHEIHILPNLTVTQMTAFISKLFDDPSQSSELLSEAKKLNDSQAPK

SEQ ID NO: 755 - protein, 58 aa, ARTIFICIAL SEQUENCE
  Engineered IL-6 binding polypeptide
VDAKYAKEERQAWTEIHSLPNLTATQVAAFIQKLFDDPSQSSELLSEAKKLNDSQAPK

SEQ ID NO: 756 - protein, 58 aa, ARTIFICIAL SEQUENCE
  Engineered IL-6 binding polypeptide
VDAKYAKEEREAWWEIHHLPNLTVHQRAAFISKLFDDPSQSSELLSEAKKLNDSQAPK

SEQ ID NO: 757 - protein, 58 aa, ARTIFICIAL SEQUENCE
  Engineered IL-6 binding polypeptide
VDAKYAKEERAAWYEIHTLPNLTVSQMTAFISKLFDDPSQSSELLSEAKKLNDSQAPK

SEQ ID NO: 758 - protein, 58 aa, ARTIFICIAL SEQUENCE
  Engineered IL-6 binding polypeptide
VDAKYAKEEHQAWWEIHLLPNLTARQMEAFIQKLFDDPSQSSELLSEAKKLNDSQAPK

SEQ ID NO: 759 - protein, 58 aa, ARTIFICIAL SEQUENCE
  Engineered IL-6 binding polypeptide
VDAKYAKEEAHAWTEIHLLPNLTVDQMVAFISKLFDDPSQSSELLSEAKKLNDSQAPK

SEQ ID NO: 760 - protein, 58 aa, ARTIFICIAL SEQUENCE
  Engineered IL-6 binding polypeptide
VDAKYAKEERRAWHEIHLLPNLTIQQIAAFISKLFDDPSQSSELLSEAKKLNDSQAPK

SEQ ID NO: 761 - protein, 58 aa, ARTIFICIAL SEQUENCE
  Engineered IL-6 binding polypeptide
VDAKYAKEEHDAWFEIHTLPNLTVEQMAAFIMKLFDDPSQSSELLSEAKKLNDSQAPK

SEQ ID NO: 762 - protein, 58 aa, ARTIFICIAL SEQUENCE
  Engineered IL-6 binding polypeptide
VDAKYAKEEHRAWLEIHLLPNLTVRQMAAFISKLFDDPSQSSELLSEAKKLNDSQAPK

SEQ ID NO: 763 - protein, 58 aa, ARTIFICIAL SEQUENCE
  Engineered IL-6 binding polypeptide
VDAKYAKEEAKAWWEIHLLPNLTVDQMAAFISKLFDDPSQSSELLSEAKKLNDSQAPK

SEQ ID NO: 764 - protein, 58 aa, ARTIFICIAL SEQUENCE
  Engineered IL-6 binding polypeptide
VDAKYAKEERKAWHEIHVLPNLTTNQRVAFIMKLMDDPSQSSELLSEAKKLNDSQAPK

SEQ ID NO: 765 - protein, 58 aa, ARTIFICIAL SEQUENCE
  Engineered IL-6 binding polypeptide
VDAKYAKEERRAWWEIHILPNLTVEQAAAFISKLFDDPSQSSELLSEAKKLNDSQAPK

SEQ ID NO: 766 - protein, 58 aa, ARTIFICIAL SEQUENCE
  Engineered IL-6 binding polypeptide
VDAKYAKEEAAAWYEIHTLPNLTIDQMAAFISKLFDDPSQSSELLSEAKKLNDSQAPK

SEQ ID NO: 767 - protein, 58 aa, ARTIFICIAL SEQUENCE
  Engineered IL-6 binding polypeptide
VDAKYAKEERAAWFEIHKLPNLTVSQMAAFIQKLFDDPSQSSELLSEAKKLNDSQAPK

SEQ ID NO: 768 - protein, 58 aa, ARTIFICIAL SEQUENCE
  Engineered IL-6 binding polypeptide
VDAKYAKEEAEAWTEIHKLPNLTVHQMTAFIIKLFDDPSQSSELLSEAKKLNDSQAPK

SEQ ID NO: 769 - protein, 58 aa, ARTIFICIAL SEQUENCE
  Engineered IL-6 binding polypeptide
VDAKYAKEERHAWWEIHKLPNLTISQMAAFISKLFDDPSQSSELLSEAKKLNDSQAPK

SEQ ID NO: 770 - protein, 58 aa, ARTIFICIAL SEQUENCE
  Engineered IL-6 binding polypeptide
VDAKYAKEERKAWYEIHLLPNLTTSQRVAFISKLFDDPSQSSELLSEAKKLNDSQAPK

SEQ ID NO: 771 - protein, 58 aa, ARTIFICIAL SEQUENCE
  Engineered IL-6 binding polypeptide
VDAKYAKEEASAWWEIHVLPNLTVNQIAAFISKLFDDPSQSSELLSEAKKLNDSQAPK

SEQ ID NO: 772 - protein, 58 aa, ARTIFICIAL SEQUENCE
  Engineered IL-6 binding polypeptide
VDAKYAKEERDAWYEIHLLPNLTTDQMAAFISKLFDDPSQSSELLSEAKKLNDSQAPK

SEQ ID NO: 773 - protein, 58 aa, ARTIFICIAL SEQUENCE
  Engineered IL-6 binding polypeptide
VDAKYAKEEAEAWLEIHLLPNLTVQQMAAFISKLFDDPSQSSELLSEAKKLNDSQAPK

SEQ ID NO: 774 - protein, 58 aa, ARTIFICIAL SEQUENCE
  Engineered IL-6 binding polypeptide
VDAKYAKEEAKAWHEIHVLPNLTVRQIAAFISKLFDDPSQSSELLSEAKKLNDSQAPK

SEQ ID NO: 775 - protein, 58 aa, ARTIFICIAL SEQUENCE
  Engineered IL-6 binding polypeptide
VDAKYAKEEASAWFEIHTLPNLTVDQMSAFIIKLFDDPSQSSELLSEAKKLNDSQAPK

SEQ ID NO: 776 - protein, 58 aa, ARTIFICIAL SEQUENCE
  Engineered IL-6 binding polypeptide
VDAKYAKEERKAWYEIHVLPNLTVEQIAAFISKLFDDPSQSSELLSEAKKLNDSQAPK

SEQ ID NO: 777 - protein, 58 aa, ARTIFICIAL SEQUENCE
  Engineered IL-6 binding polypeptide
VDAKYAKEERAAWHEIHVLPNLTTEQRVAFIIKLYDDPSQSSELLSEAKKLNDSQAPK

SEQ ID NO: 778 - protein, 58 aa, ARTIFICIAL SEQUENCE
  Engineered IL-6 binding polypeptide
VDAKYAKEEAQAWYEIHVLPNLTVRQMVAFISKLFDDPSQSSELLSEAKKLNDSQAPK

SEQ ID NO: 779 - protein, 58 aa, ARTIFICIAL SEQUENCE
  Engineered IL-6 binding polypeptide
VDAKYAKEEAQAWWEIHLLPNLTVRQIAAFISKLFDDPSQSSELLSEAKKLNDSQAPK

SEQ ID NO: 780 - protein, 58 aa, ARTIFICIAL SEQUENCE
  Engineered IL-6 binding polypeptide
VDAKYAKEEAAAWTEIHALPNLTVHQMAAFISKLFDDPSQSSELLSEAKKLNDSQAPK

SEQ ID NO: 781 - protein, 58 aa, ARTIFICIAL SEQUENCE
  Engineered IL-6 binding polypeptide
VDAKYAKEERTAWWEIHALPNLTIDQMAAFIIKLYDDPSQSSELLSEAKKLNDSQAPK

SEQ ID NO: 782 - protein, 58 aa, ARTIFICIAL SEQUENCE
  Engineered IL-6 binding polypeptide
VDAKYAKEEHKAWREIHLLPNLTTEQMTAFISKLFDDPSQSSELLSEAKKLNDSQAPK

SEQ ID NO: 783 - protein, 58 aa, ARTIFICIAL SEQUENCE
  Engineered IL-6 binding polypeptide
VDAKYAKEEQRAWREIHLLPNLTVNQMAAFITKLFDDPSQSSELLSEAKKLNDSQAPK

SEQ ID NO: 784 - protein, 58 aa, ARTIFICIAL SEQUENCE
  Engineered IL-6 binding polypeptide
VDAKYAKEERHAWWEIHKLPNLTIRQMAAFISKLFDDPSQSSELLSEAKKLNDSQAPK

SEQ ID NO: 785 - protein, 58 aa, ARTIFICIAL SEQUENCE
  Engineered IL-6 binding polypeptide
VDAKYAKEEARAWHEIHILPNLTVRQISAFISKLFDDPSQSSELLSEAKKLNDSQAPK

SEQ ID NO: 786 - protein, 58 aa, ARTIFICIAL SEQUENCE
  Engineered IL-6 binding polypeptide
VDAKYAKEERQAWFEIHALPNLTVNQMAAFIIKLYDDPSQSSELLSEAKKLNDSQAPK

SEQ ID NO: 787 - protein, 58 aa, ARTIFICIAL SEQUENCE
  Engineered IL-6 binding polypeptide
VDAKYAKEEAQAWSEIHLLPNLTIDQRVAFISKLFDDPSQSSELLSEAKKLNDSQAPK

SEQ ID NO: 788 - protein, 58 aa, ARTIFICIAL SEQUENCE
  Engineered IL-6 binding polypeptide
VDAKYAKEERHAWHEIHILPNLTINQMAAFISKLFDDPSQSSELLSEAKKLNDSQAPK

SEQ ID NO: 789 - protein, 58 aa, ARTIFICIAL SEQUENCE
  Engineered IL-6 binding polypeptide
VDAKYAKEEAKAWAEIHALPNLTVTQMSAFIQKLFDDPSQSSELLSEAKKLNDSQAPK

SEQ ID NO: 790 - protein, 58 aa, ARTIFICIAL SEQUENCE
  Engineered IL-6 binding polypeptide
VDAKYAKEERQAWFEIHILPNLTATQMAAFISKLFDDPSQSSELLSEAKKLNDSQAPK

SEQ ID NO: 791 - protein, 58 aa, ARTIFICIAL SEQUENCE
  Engineered IL-6 binding polypeptide
VDAKYAKEERRAWHEIHVLPNLTVRQMAAFISKLFDDPSQSSELLSEAKKLNDSQAPK

SEQ ID NO: 792 - protein, 58 aa, ARTIFICIAL SEQUENCE
  Engineered IL-6 binding polypeptide
VDAKYAKEEAHAWFEIHILPNLTIDQRSAFISKLFDDPSQSSELLSEAKKLNDSQAPK

SEQ ID NO: 793 - protein, 58 aa, ARTIFICIAL SEQUENCE
  Engineered IL-6 binding polypeptide
VDAKYAKEEARAWWEIHLLPNLTIRQMTAFISKLFDDPSQSSELLSEAKKLNDSQAPK

SEQ ID NO: 794 - protein, 58 aa, ARTIFICIAL SEQUENCE
  Engineered IL-6 binding polypeptide
VDAKYAKEEAEAWHEIHVLPNLTVSQMAAFISKLFDDPSQSSELLSEAKKLNDSQAPK

SEQ ID NO: 795 - protein, 58 aa, ARTIFICIAL SEQUENCE
  Engineered IL-6 binding polypeptide
VDAKYAKEERQAWREIHLLPNLTTDQMSAFISKLFDDPSQSSELLSEAKKLNDSQAPK

SEQ ID NO: 796 - protein, 58 aa, ARTIFICIAL SEQUENCE
  Engineered IL-6 binding polypeptide
VDAKYAKEEATAWREIHLLPNLTVDQMAAFISKLFDDPSQSSELLSEAKKLNDSQAPK

SEQ ID NO: 797 - protein, 58 aa, ARTIFICIAL SEQUENCE
  Engineered IL-6 binding polypeptide
VDAKYAKEERQAWWEIHKLPNLTVTQMAAFISKLFDDPSQSSELLSEAKKLNDSQAPK

SEQ ID NO: 798 - protein, 58 aa, ARTIFICIAL SEQUENCE
  Engineered IL-6 binding polypeptide
VDAKYAKEEARAWREIHLLPNLTISQMAAFISKLFDDPSQSSELLSEAKKLNDSQAPK

SEQ ID NO: 799 - protein, 58 aa, ARTIFICIAL SEQUENCE
  Engineered IL-6 binding polypeptide
VDAKYAKEEAEAWHEIHVLPNLTVEQMAAFISKLFDDPSQSSELLSEAKKLNDSQAPK

SEQ ID NO: 800 - protein, 58 aa, ARTIFICIAL SEQUENCE
  Engineered IL-6 binding polypeptide
VDAKYAKEEAAAWLEIHLLPNLTIDQMAAFISKLFDDPSQSSELLSEAKKLNDSQAPK

SEQ ID NO: 801 - protein, 58 aa, ARTIFICIAL SEQUENCE
  Engineered IL-6 binding polypeptide
VDAKYAKEERDAWYEIHLLPNLTVQQMSAFISKLFDDPSQSSELLSEAKKLNDSQAPK

SEQ ID NO: 802 - protein, 58 aa, ARTIFICIAL SEQUENCE
  Engineered IL-6 binding polypeptide
VDAKYAKEERAAWFEIHTLPNLTVHQMAAFISKLFDDPSQSSELLSEAKKLNDSQAPK

SEQ ID NO: 803 - protein, 58 aa, ARTIFICIAL SEQUENCE
  Engineered IL-6 binding polypeptide
VDAKYAKEEQSAWHEIHTLPNLTVNQMAAFIIKLFDDPSQSSELLSEAKKLNDSQAPK

SEQ ID NO: 804 - protein, 58 aa, ARTIFICIAL SEQUENCE
  Engineered IL-6 binding polypeptide
VDAKYAKEERSAWFEIHILPNLTVRQMAAFIQKLFDDPSQSSELLSEAKKLNDSQAPK

SEQ ID NO: 805 - protein, 58 aa, ARTIFICIAL SEQUENCE
  Engineered IL-6 binding polypeptide
VDAKYAKEEAQAWHEIHVLPNLTVNQMAAFISKLFDDPSQSSELLSEAKKLNDSQAPK

SEQ ID NO: 806 - protein, 58 aa, ARTIFICIAL SEQUENCE
  Engineered IL-6 binding polypeptide
VDAKYAKEEAHAWREIHLLPNLTVSQMAAFIIKLFDDPSQSSELLSEAKKLNDSQAPK

SEQ ID NO: 807 - protein, 58 aa, ARTIFICIAL SEQUENCE
  Engineered IL-6 binding polypeptide
VDAKYAKEEARAWREIHLLPNLTVQQMAAFIQKLFDDPSQSSELLSEAKKLNDSQAPK

SEQ ID NO: 808 - protein, 58 aa, ARTIFICIAL SEQUENCE
  Engineered IL-6 binding polypeptide
VDAKYAKEERQAWYEIHMLPNLTITQLEAFISKLFDDPSQSSELLSEAKKLNDSQAPK

SEQ ID NO: 809 - protein, 58 aa, ARTIFICIAL SEQUENCE
  Engineered IL-6 binding polypeptide
VDAKYAKEEREAWYEIHVLPNLTHHQMEAFIQKLFDDPSQSSELLSEAKKLNDSQAPK

SEQ ID NO: 810 - protein, 58 aa, ARTIFICIAL SEQUENCE
  Engineered IL-6 binding polypeptide
VDAKYAKEERRAWFEIHLLPNLTVTQISAFISKLFDDPSQSSELLSEAKKLNDSQAPK

SEQ ID NO: 811 - protein, 58 aa, ARTIFICIAL SEQUENCE
  Engineered IL-6 binding polypeptide
VDAKYAKEEREAWFEIHALPNLTVDQMSAFIIKLYDDPSQSSELLSEAKKLNDSQAPK

SEQ ID NO: 812 - protein, 58 aa, ARTIFICIAL SEQUENCE
  Engineered IL-6 binding polypeptide
VDAKYAKEEREAWWEIHLLPNLTVEQMAAFIHKLYDDPSQSSELLSEAKKLNDSQAPK

SEQ ID NO: 813 - protein, 58 aa, ARTIFICIAL SEQUENCE
  Engineered IL-6 binding polypeptide
VDAKYAKEEREAWHEIHTLPNLTVHQRAAFISKLFDDPSQSSELLSEAKKLNDSQAPK

SEQ ID NO: 814 - protein, 58 aa, ARTIFICIAL SEQUENCE
  Engineered IL-6 binding polypeptide
VDAKYAKEEAQAWHEIHTLPNLTVDQMAAFISKLFDDPSQSSELLSEAKKLNDSQAPK

SEQ ID NO: 815 - protein, 58 aa, ARTIFICIAL SEQUENCE
  Engineered IL-6 binding polypeptide
VDAKYAKEEQHAWYEIHILPNLTVTQMAAFISKLFDDPSQSSELLSEAKKLNDSQAPK

SEQ ID NO: 816 - protein, 58 aa, ARTIFICIAL SEQUENCE
  Engineered IL-6 binding polypeptide
VDAKYAKEEHHAWYEIHTLPNLTIQQMAAFISKLFDDPSQSSELLSEAKKLNDSQAPK

SEQ ID NO: 817 - protein, 58 aa, ARTIFICIAL SEQUENCE
  Engineered IL-6 binding polypeptide
VDAKYAKEEAHAWYEIHLLPNLTVNQMAAFIQKLFDDPSQSSELLSEAKKLNDSQAPK

SEQ ID NO: 818 - protein, 58 aa, ARTIFICIAL SEQUENCE
  Engineered IL-6 binding polypeptide
VDAKYAKEEAAAWREIHTLPNLTAEQMAAFISKLFDDPSQSSELLSEAKKLNDSQAPK

SEQ ID NO: 819 - protein, 58 aa, ARTIFICIAL SEQUENCE
  Engineered IL-6 binding polypeptide
VDAKYAKEEASAWYEIHLLPNLTVEQMAAFISKLFDDPSQSSELLSEAKKLNDSQAPK

SEQ ID NO: 820 - protein, 58 aa, ARTIFICIAL SEQUENCE
  Engineered IL-6 binding polypeptide
VDAKYAKEERKAWYEIHVLPNLTVDQMAAFIQKLFDDPSQSSELLSEAKKLNDSQAPK

SEQ ID NO: 821 - protein, 58 aa, ARTIFICIAL SEQUENCE
  Engineered IL-6 binding polypeptide
VDAKYAKEEAHAWHEIHILPNLTVNQIAAFISKLFDDPSQSSELLSEAKKLNDSQAPK

SEQ ID NO: 822 - protein, 58 aa, ARTIFICIAL SEQUENCE
  Engineered IL-6 binding polypeptide
VDAKYAKEERRAWAEIHKLPNLTISQIAAFISKLFDDPSQSSELLSEAKKLNDSQAPK

SEQ ID NO: 823 - protein, 58 aa, ARTIFICIAL SEQUENCE
  Engineered IL-6 binding polypeptide
VDAKYAKEEAHAWLEIHALPNLTIEQISAFIIKLYDDPSQSSELLSEAKKLNDSQAPK

SEQ ID NO: 824 - protein, 58 aa, ARTIFICIAL SEQUENCE
  Engineered IL-6 binding polypeptide
VDAKYAKEERTAWYEIHILPNLTIQQMAAFISKLFDDPSQSSELLSEAKKLNDSQAPK

SEQ ID NO: 825 - protein, 58 aa, ARTIFICIAL SEQUENCE
  Engineered IL-6 binding polypeptide
VDAKYAKEERHAWYEIHLLPNLTVTQMAAFISKLFDDPSQSSELLSEAKKLNDSQAPK

SEQ ID NO: 826 - protein, 58 aa, ARTIFICIAL SEQUENCE
  Engineered IL-6 binding polypeptide
VDAKYAKEERRAWYEIHLLPNLTVEQIAAFISKLFDDPSQSSELLSEAKKLNDSQAPK

SEQ ID NO: 827 - protein, 58 aa, ARTIFICIAL SEQUENCE
  Engineered IL-6 binding polypeptide
VDAKYAKEERDAWFEIHALPNLTVTQVAAFISKLFDDPSQSSELLSEAKKLNDSQAPK

SEQ ID NO: 828 - protein, 58 aa, ARTIFICIAL SEQUENCE
  Engineered IL-6 binding polypeptide
VDAKYAKEEQEAWTEIHTLPNLTIDQMTAFIIKLFDDPSQSSELLSEAKKLNDSQAPK

SEQ ID NO: 829 - protein, 58 aa, ARTIFICIAL SEQUENCE
  Engineered IL-6 binding polypeptide
VDAKYAKEEREAWWEIHALPNLTTNQIAAFISKLFDDPSQSSELLSEAKKLNDSQAPK

SEQ ID NO: 830 - protein, 58 aa, ARTIFICIAL SEQUENCE
  Engineered IL-6 binding polypeptide
VDAKYAKEERAAWYEIHLLPNLTVNQMAAFISKLFDDPSQSSELLSEAKKLNDSQAPK

SEQ ID NO: 831 - protein, 58 aa, ARTIFICIAL SEQUENCE
  Engineered IL-6 binding polypeptide
VDAKYAKEEAKAWYEIHILPNLTVTQIAAFISKLFDDPSQSSELLSEAKKLNDSQAPK

SEQ ID NO: 832 - protein, 58 aa, ARTIFICIAL SEQUENCE
  Engineered IL-6 binding polypeptide
VDAKYAKEEREAWHEIHILPNLTVNQMAAFISKLFDDPSQSSELLSEAKKLNDSQAPK

SEQ ID NO: 833 - protein, 58 aa, ARTIFICIAL SEQUENCE
  Engineered IL-6 binding polypeptide
VDAKYAKEERAAWREIHLLPNLTVSQMEAFISKLFDDPSQSSELLSEAKKLNDSQAPK

SEQ ID NO: 834 - protein, 58 aa, ARTIFICIAL SEQUENCE
  Engineered IL-6 binding polypeptide
VDAKYAKEERTAWFEIHTLPNLTVQQMAAFIIKLFDDPSQSSELLSEAKKLNDSQAPK

SEQ ID NO: 835 - protein, 58 aa, ARTIFICIAL SEQUENCE
  Engineered IL-6 binding polypeptide
VDAKYAKEEREAWHEIHILPNLTIEQMAAFIQKLFDDPSQSSELLSEAKKLNDSQAPK

SEQ ID NO: 836 - protein, 58 aa, ARTIFICIAL SEQUENCE
  Engineered IL-6 binding polypeptide
VDAKYAKEERQAWYEIHILPNLTVRQISAFISKLFDDPSQSSELLSEAKKLNDSQAPK

SEQ ID NO: 837 - protein, 58 aa, ARTIFICIAL SEQUENCE
  Engineered IL-6 binding polypeptide
VDAKYAKEEAQAWTEIHILPNLTVSQMAAFIQKLFDDPSQSSELLSEAKKLNDSQAPK

SEQ ID NO: 838 - protein, 58 aa, ARTIFICIAL SEQUENCE
  Engineered IL-6 binding polypeptide
VDAKYAKEEHDAWYEIHTLPNLTVDQVSAFISKLFDDPSQSSELLSEAKKLNDSQAPK

SEQ ID NO: 839 - protein, 58 aa, ARTIFICIAL SEQUENCE
  Engineered IL-6 binding polypeptide
VDAKYAKEEAEAWREIHLLPNLTINQIAAFISKLFDDPSQSSELLSEAKKLNDSQAPK

SEQ ID NO: 840 - protein, 58 aa, ARTIFICIAL SEQUENCE
  Engineered IL-6 binding polypeptide
VDAKYAKEEQSAWTEIHTLPNLTTDQRVAFISKLFDDPSQSSELLSEAKKLNDSQAPK

SEQ ID NO: 841 - protein, 58 aa, ARTIFICIAL SEQUENCE
  Engineered IL-6 binding polypeptide
VDAKYAKEERDAWHEIHLLPNLTIEQRAAFISKLFDDPSQSSELLSEAKKLNDSQAPK

SEQ ID NO: 842 - protein, 58 aa, ARTIFICIAL SEQUENCE
  Engineered IL-6 binding polypeptide
VDAKYAKEEARAWHEIHVLPNLTTDQRVAFISKLFDDPSQSSELLSEAKKLNDSQAPK

SEQ ID NO: 843 - protein, 58 aa, ARTIFICIAL SEQUENCE
  Engineered IL-6 binding polypeptide
VDAKYAKEEADAWFEIHMLPNLTIDQMTAFIMKLFDDPSQSSELLSEAKKLNDSQAPK

SEQ ID NO: 844 - protein, 58 aa, ARTIFICIAL SEQUENCE
  Engineered IL-6 binding polypeptide
VDAKYAKEEAEAWWEIHALPNLTVSQTAAFISKLFDDPSQSSELLSEAKKLNDSQAPK

SEQ ID NO: 845 - protein, 58 aa, ARTIFICIAL SEQUENCE
  Engineered IL-6 binding polypeptide
VDAKYAKEERDAWFEIHALPNLTISQMTAFIIKLYDDPSQSSELLSEAKKLNDSQAPK

SEQ ID NO: 846 - protein, 58 aa, ARTIFICIAL SEQUENCE
  Engineered IL-6 binding polypeptide
VDAKYAKEERRAWYEIHTLPNLTVSQMAAFISKLFDDPSQSSELLSEAKKLNDSQAPK

SEQ ID NO: 847 - protein, 58 aa, ARTIFICIAL SEQUENCE
  Engineered IL-6 binding polypeptide
VDAKYAKEEREAWYEIHLLPNLTTRQMAAFIIKLFDDPSQSSELLSEAKKLNDSQAPK

SEQ ID NO: 848 - protein, 58 aa, ARTIFICIAL SEQUENCE
  Engineered IL-6 binding polypeptide
VDAKYAKEEHDAWYEIHVLPNLTVNQIAAFISKLFDDPSQSSELLSEAKKLNDSQAPK

SEQ ID NO: 849 - protein, 58 aa, ARTIFICIAL SEQUENCE
  Engineered IL-6 binding polypeptide
VDAKYAKEEAHAWAEIHSLPNLTVDQMVAFIQKLFDDPSQSSELLSEAKKLNDSQAPK

SEQ ID NO: 850 - protein, 58 aa, ARTIFICIAL SEQUENCE
  Engineered IL-6 binding polypeptide
VDAKYAKEEREAWWEIHKLPNLTVTQMAAFIQKLFDDPSQSSELLSEAKKLNDSQAPK

SEQ ID NO: 851 - protein, 58 aa, ARTIFICIAL SEQUENCE
  Engineered IL-6 binding polypeptide
VDAKYAKEERVAWYEIHLLPNLTIDQMAAFISKLFDDPSQSSELLSEAKKLNDSQAPK

SEQ ID NO: 852 - protein, 58 aa, ARTIFICIAL SEQUENCE
  Engineered IL-6 binding polypeptide
VDAKYAKEEARAWHEIHILPNLTVSQITAFISKLFDDPSQSSELLSEAKKLNDSQAPK

SEQ ID NO: 853 - protein, 58 aa, ARTIFICIAL SEQUENCE
  Engineered IL-6 binding polypeptide
VDAKYAKEEADAWREIHLLPNLTASQMAAFISKLFDDPSQSSELLSEAKKLNDSQAPK

SEQ ID NO: 854 - protein, 58 aa, ARTIFICIAL SEQUENCE
  Engineered IL-6 binding polypeptide
VDAKYAKEEREAWTEIHSLPNLTVDQMAAFIIKLYDDPSQSSELLSEAKKLNDSQAPK

SEQ ID NO: 855 - protein, 58 aa, ARTIFICIAL SEQUENCE
  Engineered IL-6 binding polypeptide
VDAKYAKEERRAWYEIHLLPNLTIEQMAAFISKLFDDPSQSSELLSEAKKLNDSQAPK

SEQ ID NO: 856 - protein, 58 aa, ARTIFICIAL SEQUENCE
  Engineered IL-6 binding polypeptide
VDAKYAKEEREAWYEIHLLPNLTIDQMAAFISKLFDDPSQSSELLSEAKKLNDSQAPK

SEQ ID NO: 857 - protein, 58 aa, ARTIFICIAL SEQUENCE
  Engineered IL-6 binding polypeptide
VDAKYAKEEARAWYEIHILPNLTVSQMAAFISKLFDDPSQSSELLSEAKKLNDSQAPK

SEQ ID NO: 858 - protein, 58 aa, ARTIFICIAL SEQUENCE
  Engineered IL-6 binding polypeptide
VDAKYAKEERQAWHEIHTLPNLTTDQMAAFISKLFDDPSQSSELLSEAKKLNDSQAPK

SEQ ID NO: 859 - protein, 58 aa, ARTIFICIAL SEQUENCE
  Engineered IL-6 binding polypeptide
VDAKYAKEEHDAWWEIHKLPNLTVNQTAAFISKLFDDPSQSSELLSEAKKLNDSQAPK

SEQ ID NO: 860 - protein, 58 aa, ARTIFICIAL SEQUENCE
  Engineered IL-6 binding polypeptide
VDAKYAKEERTAWHEIHSLPNLTIDQMAAFIIKLFDDPSQSSELLSEAKKLNDSQAPK

SEQ ID NO: 861 - protein, 58 aa, ARTIFICIAL SEQUENCE
  Engineered IL-6 binding polypeptide
VDAKYAKEERAAWWEIHLLPNLTTTQMAAFISKLFDDPSQSSELLSEAKKLNDSQAPK

SEQ ID NO: 862 - protein, 58 aa, ARTIFICIAL SEQUENCE
  Engineered IL-6 binding polypeptide
VDAKYAKEERDAWREIHLLPNLTIDQMAAFISKLFDDPSQSSELLSEAKKLNDSQAPK

SEQ ID NO: 863 - protein, 58 aa, ARTIFICIAL SEQUENCE
  Engineered IL-6 binding polypeptide
VDAKYAKEEQVAWHEIHLLPNLTIDQMTAFISKLFDDPSQSSELLSEAKKLNDSQAPK

SEQ ID NO: 864 - protein, 58 aa, ARTIFICIAL SEQUENCE
  Engineered IL-6 binding polypeptide
VDAKYAKEEAQAWREIHLLPNLTVDQMAAFISKLFDDPSQSSELLSEAKKLNDSQAPK

SEQ ID NO: 865 - protein, 58 aa, ARTIFICIAL SEQUENCE
  Engineered IL-6 binding polypeptide
VDAKYAKEEAKAWFEIHILPNLTVQQVAAFISKLFDDPSQSSELLSEAKKLNDSQAPK

SEQ ID NO: 866 - protein, 58 aa, ARTIFICIAL SEQUENCE
  Engineered IL-6 binding polypeptide
VDAKYAKEEHAAWREITLLPNLTINQRAAFISKLFDDPSQSSELLSEAKKLNDSQAPK

SEQ ID NO: 867 - protein, 58 aa, ARTIFICIAL SEQUENCE
  Engineered IL-6 binding polypeptide
VDAKYAKEEAEAWSEIHKLPNLTVTQMAAFISKLFDDPSQSSELLSEAKKLNDSQAPK

SEQ ID NO: 868 - protein, 58 aa, ARTIFICIAL SEQUENCE
  Engineered IL-6 binding polypeptide
VDAKYAKEEQQAWYEIHLLPNLTVTQMSAFISKLFDDPSQSSELLSEAKKLNDSQAPK

SEQ ID NO: 869 - protein, 58 aa, ARTIFICIAL SEQUENCE
  Engineered IL-6 binding polypeptide
VDAKYAKEEARAWYEIHLLPNLTIEQMAAFISKLFDDPSQSSELLSEAKKLNDSQAPK

SEQ ID NO: 870 - protein, 58 aa, ARTIFICIAL SEQUENCE
  Engineered IL-6 binding polypeptide
VDAKYAKEEAEAWTEIHLLPNLTVEQRVAFISKLFDDPSQSSELLSEAKKLNDSQAPK

SEQ ID NO: 871 - protein, 58 aa, ARTIFICIAL SEQUENCE
  Engineered IL-6 binding polypeptide
VDAKYAKEERQAWTEIHLLPNLTVEQMAAFIQKLFDDPSQSSELLSEAKKLNDSQAPK

SEQ ID NO: 872 - protein, 58 aa, ARTIFICIAL SEQUENCE
  Engineered IL-6 binding polypeptide
VDAKYAKEEYYAWTEIHKLPNLTIDQMAAFITKLFDDPSQSSELLSEAKKLNDSQAPK

SEQ ID NO: 873 - protein, 58 aa, ARTIFICIAL SEQUENCE
  Engineered IL-6 binding polypeptide
VDAKYAKEEQAAWMEIHLLPNLTIDQMAAFITKLFDDPSQSSELLSEAKKLNDSQAPK

SEQ ID NO: 874 - protein, 58 aa, ARTIFICIAL SEQUENCE
  Engineered IL-6 binding polypeptide
VDAKYAKEEYAAWTEIHLLPNLTIDQMAAFITKLFDDPSQSSELLSEAKKLNDSQAPK

SEQ ID NO: 875 - protein, 58 aa, ARTIFICIAL SEQUENCE
  Engineered IL-6 binding polypeptide
VDAKYAKEEKEAWYEIHILPNLTISQMAAFITKLFDDPSQSSELLSEAKKLNDSQAPK

SEQ ID NO: 876 - protein, 58 aa, ARTIFICIAL SEQUENCE
  Engineered IL-6 binding polypeptide
VDAKYAKEEREAWYEIHLLPNLTIVQMAAFISKLFDDPSQSSELLSEAKKLNDSQAPK

SEQ ID NO: 877 - protein, 58 aa, ARTIFICIAL SEQUENCE
  Engineered IL-6 binding polypeptide
VDAKYAKEEYAAWVEIHKLPNLTVDQMAAFITKLFDDPSQSSELLSEAKKLNDSQAPK

SEQ ID NO: 878 - protein, 58 aa, ARTIFICIAL SEQUENCE
  Engineered IL-6 binding polypeptide
VDAKYAKEEAYAWKEIHKLPNLTIEQMAAFITKLFDDPSQSSELLSEAKKLNDSQAPK

SEQ ID NO: 879 - protein, 58 aa, ARTIFICIAL SEQUENCE
  Engineered IL-6 binding polypeptide
VDAKYAKEEKAAWTEIHLLPNLTIFQMAAFISKLFDDPSQSSELLSEAKKLNDSQAPK

SEQ ID NO: 880 - protein, 58 aa, ARTIFICIAL SEQUENCE
  Engineered IL-6 binding polypeptide
VDAKYAKEEKEAWYEIHLLPNLTITQMAAFITKLFDDPSQSSELLSEAKKLNDSQAPK

SEQ ID NO: 881 - protein, 58 aa, ARTIFICIAL SEQUENCE
  Engineered IL-6 binding polypeptide
VDAKYAKEERKAWYEIHLLPNLTVTQMAAFISKLFDDPSQSSELLSEAKKLNDSQAPK

SEQ ID NO: 882 - protein, 58 aa, ARTIFICIAL SEQUENCE
  Engineered IL-6 binding polypeptide
VDAKYAKEEAMAWREIHLLPNLTVNQIAAFITKLFDDPSQSSELLSEAKKLNDSQAPK

SEQ ID NO: 883 - protein, 58 aa, ARTIFICIAL SEQUENCE
  Engineered IL-6 binding polypeptide
VDAKYAKEEKHAWNEIHKLPNLTVEQMAAFITKLFDDPSQSSELLSEAKKLNDSQAPK

SEQ ID NO: 884 - protein, 58 aa, ARTIFICIAL SEQUENCE
  Engineered IL-6 binding polypeptide
VDAKYAKEEYEAWTEIHKLPNLTIDQMAAFITKLFDDPSQSSELLSEAKKLNDSQAPK

SEQ ID NO: 885 - protein, 58 aa, ARTIFICIAL SEQUENCE
  Engineered IL-6 binding polypeptide
VDAKYAKEEWNAWTEIHNLPNLTIDQMAAFITKLFDDPSQSSELLSEAKKLNDSQAPK

SEQ ID NO: 886 - protein, 58 aa, ARTIFICIAL SEQUENCE
  Engineered IL-6 binding polypeptide
VDAKYAKEERAAWTEIHGLPNLTVEQMAAFITKLFDDPSQSSELLSEAKKLNDSQAPK

SEQ ID NO: 887 - protein, 58 aa, ARTIFICIAL SEQUENCE
  Engineered IL-6 binding polypeptide
VDAKYAKEEADAWLEIHNLPNLTISQMAAFITKLFDDPSQSSELLSEAKKLNDSQAPK

SEQ ID NO: 888 - protein, 58 aa, ARTIFICIAL SEQUENCE
  Engineered IL-6 binding polypeptide
VDAKYAKEEKAAWHEIHILPNLTVYQIAAFITKLFDDPSQSSELLSEAKKLNDSQAPK

SEQ ID NO: 889 - protein, 58 aa, ARTIFICIAL SEQUENCE
  Engineered IL-6 binding polypeptide
VDAKYAKEEEKAWWEIHILPNLTIEQMAAFISKLFDDPSQSSELLSEAKKLNDSQAPK

SEQ ID NO: 890 - protein, 58 aa, ARTIFICIAL SEQUENCE
  Engineered IL-6 binding polypeptide
VDAKYAKEEKSAWMEIHLLPNLTIEQMAAFITKLFDDPSQSSELLSEAKKLNDSQAPK

SEQ ID NO: 891 - protein, 58 aa, ARTIFICIAL SEQUENCE
  Engineered IL-6 binding polypeptide
VDAKYAKEEYAAWMEIHRLPNLTIEQIAAFITKLFDDPSQSSELLSEAKKLNDSQAPK

SEQ ID NO: 892 - protein, 58 aa, ARTIFICIAL SEQUENCE
  Engineered IL-6 binding polypeptide
VDAKYAKEEFRAWIEIHTLPNLTVDQMAAFITKLFDDPSQSSELLSEAKKLNDSQAPK

SEQ ID NO: 893 - protein, 58 aa, ARTIFICIAL SEQUENCE
  Engineered IL-6 binding polypeptide
VDAKYAKEEKDAWNEIHKLPNLTIEQIAAFITKLFDDPSQSSELLSEAKKLNDSQAPK

SEQ ID NO: 894 - protein, 58 aa, ARTIFICIAL SEQUENCE
  Engineered IL-6 binding polypeptide
VDAKYAKEEKHAWYEIHLLPNLTVEQMAAFITKLFDDPSQSSELLSEAKKLNDSQAPK

SEQ ID NO: 895 - protein, 58 aa, ARTIFICIAL SEQUENCE
  Engineered IL-6 binding polypeptide
VDAKYAKEEYEAWLEIHLLPNLTVDQMAAFISKLFDDPSQSSELLSEAKKLNDSQAPK

SEQ ID NO: 896 - protein, 58 aa, ARTIFICIAL SEQUENCE
  Engineered IL-6 binding polypeptide
VDAKYAKEEKNAWHEIHRLPNLTVNQMAAFITKLFDDPSQSSELLSEAKKLNDSQAPK

SEQ ID NO: 897 - protein, 58 aa, ARTIFICIAL SEQUENCE
  Engineered IL-6 binding polypeptide
VDAKYAKEEKNAWTEIHNLPNLTISQMAAFITKLFDDPSQSSELLSEAKKLNDSQAPK

SEQ ID NO: 898 - protein, 58 aa, ARTIFICIAL SEQUENCE
  Engineered IL-6 binding polypeptide
VDAKYAKEEAAAWYEIHALPNLTVEQMAAFITKLFDDPSQSSELLSEAKKLNDSQAPK

SEQ ID NO: 899 - protein, 58 aa, ARTIFICIAL SEQUENCE
  Engineered IL-6 binding polypeptide
VDAKYAKEEWNAWMEIHLLPNLTVTQMAAFITKLFDDPSQSSELLSEAKKLNDSQAPK

SEQ ID NO: 900 - protein, 58 aa, ARTIFICIAL SEQUENCE
  Engineered IL-6 binding polypeptide
VDAKYAKEEAKAWHEIHILPNLTVHQIAAFITKLFDDPSQSSELLSEAKKLNDSQAPK

SEQ ID NO: 901 - protein, 58 aa, ARTIFICIAL SEQUENCE
  Engineered IL-6 binding polypeptide
VDAKYAKEERKAWHEIHILPNLTVHQIAAFITKLFDDPSQSSELLSEAKKLNDSQAPK

SEQ ID NO: 902 - protein, 58 aa, ARTIFICIAL SEQUENCE
  Engineered IL-6 binding polypeptide
VDAKYAKEESKAWFEIHALPNLTVEQIAAFITKLFDDPSQSSELLSEAKKLNDSQAPK

SEQ ID NO: 903 - protein, 58 aa, ARTIFICIAL SEQUENCE
  Engineered IL-6 binding polypeptide
VDAKYAKEEKRAWYEIHILPNLTISQIAAFITKLFDDPSQSSELLSEAKKLNDSQAPK

SEQ ID NO: 904 - protein, 58 aa, ARTIFICIAL SEQUENCE
  Engineered IL-6 binding polypeptide
VDAKYAKEEKKAWTEIHVLPNLTISQIAAFISKLFDDPSQSSELLSEAKKLNDSQAPK

SEQ ID NO: 905 - protein, 58 aa, ARTIFICIAL SEQUENCE
  Engineered IL-6 binding polypeptide
VDAKYAKEERDAWFEIHALPNLTIDQMAAFITKLFDDPSQSSELLSEAKKLNDSQAPK

SEQ ID NO: 906 - protein, 58 aa, ARTIFICIAL SEQUENCE
  Engineered IL-6 binding polypeptide
VDAKYAKEEYEAWEEIHRLPNLTIDQMAAFISKLFDDPSQSSELLSEAKKLNDSQAPK

SEQ ID NO: 907 - protein, 58 aa, ARTIFICIAL SEQUENCE
  Engineered IL-6 binding polypeptide
VDAKYAKEERNAWFEIHKLPNLTINQMAAFISKLFDDPSQSSELLSEAKKLNDSQAPK

SEQ ID NO: 908 - protein, 58 aa, ARTIFICIAL SEQUENCE
  Engineered IL-6 binding polypeptide
VDAKYAKEEHHAWNEIHKLPNLTVDQIAAFISKLFDDPSQSSELLSEAKKLNDSQAPK

SEQ ID NO: 909 - protein, 58 aa, ARTIFICIAL SEQUENCE
  Engineered IL-6 binding polypeptide
VDAKYAKEEHYAWKEIHLLPNLTIDQMAAFITKLFDDPSQSSELLSEAKKLNDSQAPK

SEQ ID NO: 910 - protein, 58 aa, ARTIFICIAL SEQUENCE
  Engineered IL-6 binding polypeptide
VDAKYAKEESDAWYEIHLLPNLTIEQMAAFITKLFDDPSQSSELLSEAKKLNDSQAPK

SEQ ID NO: 911 - protein, 58 aa, ARTIFICIAL SEQUENCE
  Engineered IL-6 binding polypeptide
VDAKYAKEEYEAWMEIHLLPNLTIGQMAAFITKLFDDPSQSSELLSEAKKLNDSQAPK

SEQ ID NO: 912 - protein, 58 aa, ARTIFICIAL SEQUENCE
  Engineered IL-6 binding polypeptide
VDAKYAKEEKEAWYEIHLLPNLTVEQMAAFISKLFDDPSQSSELLSEAKKLNDSQAPK

SEQ ID NO: 913 - protein, 58 aa, ARTIFICIAL SEQUENCE
  Engineered IL-6 binding polypeptide
VDAKYAKEERAAWKEIHILPNLTVEQIAAFITKLFDDPSQSSELLSEAKKLNDSQAPK

SEQ ID NO: 914 - protein, 58 aa, ARTIFICIAL SEQUENCE
  Engineered IL-6 binding polypeptide
VDAKYAKEEKEAWYEIHILPNLTVHQMAAFITKLFDDPSQSSELLSEAKKLNDSQAPK

SEQ ID NO: 915 - protein, 58 aa, ARTIFICIAL SEQUENCE
  Engineered IL-6 binding polypeptide
VDAKYAKEEYDAWIEIHALPNLTVDQMAAFISKLFDDPSQSSELLSEAKKLNDSQAPK

SEQ ID NO: 916 - protein, 58 aa, ARTIFICIAL SEQUENCE
  Engineered IL-6 binding polypeptide
VDAKYAKEERKAWTEIHLLPNLTIDQMAAFITKLFDDPSQSSELLSEAKKLNDSQAPK

SEQ ID NO: 917 - protein, 58 aa, ARTIFICIAL SEQUENCE
  Engineered IL-6 binding polypeptide
VDAKYAKEEYHAWVEIHNLPNLTIDQIAAFITKLFDDPSQSSELLSEAKKLNDSQAPK

SEQ ID NO: 918 - protein, 58 aa, ARTIFICIAL SEQUENCE
  Engineered IL-6 binding polypeptide
VDAKYAKEEREAWTEIHKLPNLTIDQMAAFITKLFDDPSQSSELLSEAKKLNDSQAPK

SEQ ID NO: 919 - protein, 58 aa, ARTIFICIAL SEQUENCE
  Engineered IL-6 binding polypeptide
VDAKYAKEEQWAWYEIHLLPNLTVNQMAAFITKLFDDPSQSSELLSEAKKLNDSQAPK

SEQ ID NO: 920 - protein, 58 aa, ARTIFICIAL SEQUENCE
  Engineered IL-6 binding polypeptide
VDAKYAKEEKQAWMEIHKLPNLTVHQVAAFISKLFDDPSQSSELLSEAKKLNDSQAPK

SEQ ID NO: 921 - protein, 58 aa, ARTIFICIAL SEQUENCE
  Engineered IL-6 binding polypeptide
VDAKYAKEESDAWTEIHKLPNLTIDQMAAFITKLFDDPSQSSELLSEAKKLNDSQAPK

SEQ ID NO: 922 - protein, 58 aa, ARTIFICIAL SEQUENCE
  Engineered IL-6 binding polypeptide
VDAKYAKEEAQAWWEIHSLPNLTVDQIAAFITKLFDDPSQSSELLSEAKKLNDSQAPK

SEQ ID NO: 923 - protein, 58 aa, ARTIFICIAL SEQUENCE
  Engineered IL-6 binding polypeptide
VDAKYAKEEKMAWYEIHNLPNLTVNQMAAFITKLFDDPSQSSELLSEAKKLNDSQAPK

SEQ ID NO: 924 - protein, 58 aa, ARTIFICIAL SEQUENCE
  Engineered IL-6 binding polypeptide
VDAKYAKEEWMAWMEIHNLPNLTVNQMAAFITKLFDDPSQSSELLSEAKKLNDSQAPK

SEQ ID NO: 925 - protein, 58 aa, ARTIFICIAL SEQUENCE
  Engineered IL-6 binding polypeptide
VDAKYAKEEARAWYEIHILPNLTVKQMAAFITKLFDDPSQSSELLSEAKKLNDSQAPK

SEQ ID NO: 926 - protein, 58 aa, ARTIFICIAL SEQUENCE
  Engineered IL-6 binding polypeptide
VDAKYAKEEAKAWHEIHILPNLTVSQVAAFITKLFDDPSQSSELLSEAKKLNDSQAPK

SEQ ID NO: 927 - protein, 58 aa, ARTIFICIAL SEQUENCE
  Engineered IL-6 binding polypeptide
VDAKYAKEERAAWHEIHILPNLTVDQMAAFISKLFDDPSQSSELLSEAKKLNDSQAPK

SEQ ID NO: 928 - protein, 58 aa, ARTIFICIAL SEQUENCE
  Engineered IL-6 binding polypeptide
VDAKYAKEEWQAWTEIHLLPNLTLDQVAAFITKLFDDPSQSSELLSEAKKLNDSQAPK

SEQ ID NO: 929 - protein, 58 aa, ARTIFICIAL SEQUENCE
  Engineered IL-6 binding polypeptide
VDAKYAKEEAFAWEEIHRLPNLTIEQMAAFISKLFDDPSQSSELLSEAKKLNDSQAPK

SEQ ID NO: 930 - protein, 58 aa, ARTIFICIAL SEQUENCE
  Engineered IL-6 binding polypeptide
VDAKYAKEERKAWYEIHKLPNLTVDQMAAFITKLFDDPSQSSELLSEAKKLNDSQAPK

SEQ ID NO: 931 - protein, 58 aa, ARTIFICIAL SEQUENCE
  Engineered IL-6 binding polypeptide
VDAKYAKEEKQAWYEIHLLPNLTVEQMAAFITKLFDDPSQSSELLSEAKKLNDSQAPK

SEQ ID NO: 932 - protein, 58 aa, ARTIFICIAL SEQUENCE
  Engineered IL-6 binding polypeptide
VDAKYAKEEYDAWWEIHLLPNLTVDQMAAFITKLFDDPSQSSELLSEAKKLNDSQAPK

SEQ ID NO: 933 - protein, 58 aa, ARTIFICIAL SEQUENCE
  Engineered IL-6 binding polypeptide
VDAKYAKEEHDAWNEIHLLPNLTIDQMAAFITKLFDDPSQSSELLSEAKKLNDSQAPK

SEQ ID NO: 934 - protein, 58 aa, ARTIFICIAL SEQUENCE
  Engineered IL-6 binding polypeptide
VDAKYAKEEYTAWTEIHQLPNLTVQQMAAFITKLFDDPSQSSELLSEAKKLNDSQAPK

SEQ ID NO: 935 - protein, 58 aa, ARTIFICIAL SEQUENCE
  Engineered IL-6 binding polypeptide
VDAKYAKEEARAWHEIHILPNLTVRQIAAFITKLFDDPSQSSELLSEAKKLNDSQAPK

SEQ ID NO: 936 - protein, 58 aa, ARTIFICIAL SEQUENCE
  Engineered IL-6 binding polypeptide
VDAKYAKEERNAWFEIHQLPNLTVHQVAAFITKLFDDPSQSSELLSEAKKLNDSQAPK

SEQ ID NO: 937 - protein, 58 aa, ARTIFICIAL SEQUENCE
  Engineered IL-6 binding polypeptide
VDAKYAKEEADAWYEIHLLPNLTVEQMAAFITKLFDDPSQSSELLSEAKKLNDSQAPK

SEQ ID NO: 938 - protein, 58 aa, ARTIFICIAL SEQUENCE
  Engineered IL-6 binding polypeptide
VDAKYAKEEFEAWKEIHILPNLTVDQMAAFITKLFDDPSQSSELLSEAKKLNDSQAPK

SEQ ID NO: 939 - protein, 58 aa, ARTIFICIAL SEQUENCE
  Engineered IL-6 binding polypeptide
VDAKYAKEEAYAWWEIHKLPNLTVHQMAAFITKLFDDPSQSSELLSEAKKLNDSQAPK

SEQ ID NO: 940 - protein, 58 aa, ARTIFICIAL SEQUENCE
  Engineered IL-6 binding polypeptide
VDAKYAKEEKTAWHEIHNLPNLTIDQMAAFITKLFDDPSQSSELLSEAKKLNDSQAPK

SEQ ID NO: 941 - protein, 58 aa, ARTIFICIAL SEQUENCE
  Engineered IL-6 binding polypeptide
VDAKYAKEEAKAWNEIHKLPNLTIDQIAAFISKLFDDPSQSSELLSEAKKLNDSQAPK

SEQ ID NO: 942 - protein, 58 aa, ARTIFICIAL SEQUENCE
  Engineered IL-6 binding polypeptide
VDAKYAKEEKDAWIEIHNLPNLTVEQMAAFITKLFDDPSQSSELLSEAKKLNDSQAPK

SEQ ID NO: 943 - protein, 58 aa, ARTIFICIAL SEQUENCE
  Engineered IL-6 binding polypeptide
VDAKYAKEEFFAWKEIHLLPNLTVEQIAAFITKLFDDPSQSSELLSEAKKLNDSQAPK

SEQ ID NO: 944 - protein, 58 aa, ARTIFICIAL SEQUENCE
  Engineered IL-6 binding polypeptide
VDAKYAKEEQAAWLEIHLLPNLTVSQIAAFITKLFDDPSQSSELLSEAKKLNDSQAPK

SEQ ID NO: 945 - protein, 58 aa, ARTIFICIAL SEQUENCE
  Engineered IL-6 binding polypeptide
VDAKYAKEEYFAWREIHVLPNLTVDQMAAFISKLFDDPSQSSELLSEAKKLNDSQAPK

SEQ ID NO: 946 - protein, 58 aa, ARTIFICIAL SEQUENCE
  Engineered IL-6 binding polypeptide
VDAKYAKEEYYAWREIHLLPNLTITQMAAFITKLFDDPSQSSELLSEAKKLNDSQAPK

SEQ ID NO: 947 - protein, 58 aa, ARTIFICIAL SEQUENCE
  Engineered IL-6 binding polypeptide
VDAKYAKEEKMAWTEIHLLPNLTISQMAAFITKLFDDPSQSSELLSEAKKLNDSQAPK

SEQ ID NO: 948 - protein, 58 aa, ARTIFICIAL SEQUENCE
  Engineered IL-6 binding polypeptide
VDAKYAKEERNAWFEIHVLPNLTVKQMAAFITKLFDDPSQSSELLSEAKKLNDSQAPK

SEQ ID NO: 949 - protein, 58 aa, ARTIFICIAL SEQUENCE
  Engineered IL-6 binding polypeptide
VDAKYAKEEKRAWTEIHILPNLTVEQMAAFISKLFDDPSQSSELLSEAKKLNDSQAPK

SEQ ID NO: 950 - protein, 58 aa, ARTIFICIAL SEQUENCE
  Engineered IL-6 binding polypeptide
VDAKYAKEEAAAWKEIHLLPNLTIDQMAAFITKLFDDPSQSSELLSEAKKLNDSQAPK

SEQ ID NO: 951 - protein, 58 aa, ARTIFICIAL SEQUENCE
  Engineered IL-6 binding polypeptide
VDAKYAKEEKEAWMEIHALPNLTVDQVAAFITKLFDDPSQSSELLSEAKKLNDSQAPK

SEQ ID NO: 952 - protein, 58 aa, ARTIFICIAL SEQUENCE
  Engineered IL-6 binding polypeptide
VDAKYAKEEKEAWYEIHNLPNLTIIQMAAFISKLFDDPSQSSELLSEAKKLNDSQAPK

SEQ ID NO: 953 - protein, 58 aa, ARTIFICIAL SEQUENCE
  Engineered IL-6 binding polypeptide
VDAKYAKEEYDAWFEIHILPNLTVHQIAAFITKLFDDPSQSSELLSEAKKLNDSQAPK

SEQ ID NO: 954 - protein, 58 aa, ARTIFICIAL SEQUENCE
  Engineered IL-6 binding polypeptide
VDAKYAKEEYGAWNEIHKLPNLTIDQMAAFITKLFDDPSQSSELLSEAKKLNDSQAPK

SEQ ID NO: 955 - protein, 58 aa, ARTIFICIAL SEQUENCE
  Engineered IL-6 binding polypeptide
VDAKYAKEEWQAWMEIHSLPNLTVDQMAAFITKLFDDPSQSSELLSEAKKLNDSQAPK

SEQ ID NO: 956 - protein, 58 aa, ARTIFICIAL SEQUENCE
  Engineered IL-6 binding polypeptide
VDAKYAKEEWNAWFEIHKLPNLTVEQMAAFITKLFDDPSQSSELLSEAKKLNDSQAPK

SEQ ID NO: 957 - protein, 58 aa, ARTIFICIAL SEQUENCE
  Engineered IL-6 binding polypeptide
VDAKYAKEEANAWKEIHLLPNLTVDQMAAFITKLFDDPSQSSELLSEAKKLNDSQAPK

SEQ ID NO: 958 - protein, 58 aa, ARTIFICIAL SEQUENCE
  Engineered IL-6 binding polypeptide
VDAKYAKEEYEAWTEIHLLPNLTVHQMAAFITKLFDDPSQSSELLSEAKKLNDSQAPK

SEQ ID NO: 959 - protein, 58 aa, ARTIFICIAL SEQUENCE
  Engineered IL-6 binding polypeptide
VDAKYAKEERIAWWEIHSLPNLTVNQVAAFISKLFDDPSQSSELLSEAKKLNDSQAPK

SEQ ID NO: 960 - protein, 58 aa, ARTIFICIAL SEQUENCE
  Engineered IL-6 binding polypeptide
VDAKYAKEEYNAWVEIHTLPNLTVNQMAAFITKLFDDPSQSSELLSEAKKLNDSQAPK

SEQ ID NO: 961 - protein, 58 aa, ARTIFICIAL SEQUENCE
  Engineered IL-6 binding polypeptide
VDAKYAKEEAFAWSEIHILPNLTIDQIAAFITKLFDDPSQSSELLSEAKKLNDSQAPK

SEQ ID NO: 962 - protein, 58 aa, ARTIFICIAL SEQUENCE
  Engineered IL-6 binding polypeptide
VDAKYAKEEAHAWHEIHILPNLTIDQMAAFISKLFDDPSQSSELLSEAKKLNDSQAPK

SEQ ID NO: 963 - protein, 58 aa, ARTIFICIAL SEQUENCE
  Engineered IL-6 binding polypeptide
VDAKYAKEEAAAWNEIHRLPNLTVDQIAAFISKLFDDPSQSSELLSEAKKLNDSQAPK

SEQ ID NO: 964 - protein, 58 aa, ARTIFICIAL SEQUENCE
  Engineered IL-6 binding polypeptide
VDAKYAKEEKAAWTEIHLLPNLTVDQMAAFITKLFDDPSQSSELLSEAKKLNDSQAPK

SEQ ID NO: 965 - protein, 58 aa, ARTIFICIAL SEQUENCE
  Engineered IL-6 binding polypeptide
VDAKYAKEEKGAWNEIHLLPNLTIQQMAAFISKLFDDPSQSSELLSEAKKLNDSQAPK

SEQ ID NO: 966 - protein, 58 aa, ARTIFICIAL SEQUENCE
  Engineered IL-6 binding polypeptide
VDAKYAKEEYAAWMEIHSLPNLTVDQMAAFITKLFDDPSQSSELLSEAKKLNDSQAPK

SEQ ID NO: 967 - protein, 58 aa, ARTIFICIAL SEQUENCE
  Engineered IL-6 binding polypeptide
VDAKYAKEEAAAWKEIHILPNLTIEQIAAFISKLFDDPSQSSELLSEAKKLNDSQAPK

SEQ ID NO: 968 - protein, 58 aa, ARTIFICIAL SEQUENCE
  Engineered IL-6 binding polypeptide
VDAKYAKEEKFAWNEIHILPNLTVHQIAAFITKLFDDPSQSSELLSEAKKLNDSQAPK

SEQ ID NO: 969 - protein, 58 aa, ARTIFICIAL SEQUENCE
  Engineered IL-6 binding polypeptide
VDAKYAKEEYNAWLEIHKLPNLTINQMAAFITKLFDDPSQSSELLSEAKKLNDSQAPK

SEQ ID NO: 970 - protein, 58 aa, ARTIFICIAL SEQUENCE
  Engineered IL-6 binding polypeptide
VDAKYAKEEHTAWLEIHSLPNLTIEQVAAFITKLFDDPSQSSELLSEAKKLNDSQAPK

SEQ ID NO: 971 - protein, 58 aa, ARTIFICIAL SEQUENCE
  Engineered IL-6 binding polypeptide
VDAKYAKEEKDAWMEIHILPNLTVDQMAAFITKLFDDPSQSSELLSEAKKLNDSQAPK

SEQ ID NO: 972 - protein, 58 aa, ARTIFICIAL SEQUENCE
  Engineered IL-6 binding polypeptide
VDAKYAKEEATAWIEIHSLPNLTVDQMAAFITKLFDDPSQSSELLSEAKKLNDSQAPK

SEQ ID NO: 973 - protein, 58 aa, ARTIFICIAL SEQUENCE
  Engineered IL-6 binding polypeptide
VDAKYAKEEKEAWWEIHLLPNLTVDQMAAFITKLFDDPSQSSELLSEAKKLNDSQAPK

SEQ ID NO: 974 - protein, 58 aa, ARTIFICIAL SEQUENCE
  Engineered IL-6 binding polypeptide
VDAKYAKEEQHAWIEIHKLPNLTVDQMAAFITKLFDDPSQSSELLSEAKKLNDSQAPK

SEQ ID NO: 975 - protein, 58 aa, ARTIFICIAL SEQUENCE
  Engineered IL-6 binding polypeptide
VDAKYAKEEKHAWHEIHILPNLTIEQMAAFISKLFDDPSQSSELLSEAKKLNDSQAPK

SEQ ID NO: 976 - protein, 58 aa, ARTIFICIAL SEQUENCE
  Engineered IL-6 binding polypeptide
VDAKYAKEEAKAWHEIHILPNLTIEQMAAFITKLFDDPSQSSELLSEAKKLNDSQAPK

SEQ ID NO: 977 - protein, 58 aa, ARTIFICIAL SEQUENCE
  Engineered IL-6 binding polypeptide
VDAKYAKEEKKAWTEIHILPNLTVEQIAAFITKLFDDPSQSSELLSEAKKLNDSQAPK

SEQ ID NO: 978 - protein, 58 aa, ARTIFICIAL SEQUENCE
  Engineered IL-6 binding polypeptide
VDAKYAKEERAAWYEIHVLPNLTVSQMAAFISKLFDDPSQSSELLSEAKKLNDSQAPK

SEQ ID NO: 979 - protein, 58 aa, ARTIFICIAL SEQUENCE
  Engineered IL-6 binding polypeptide
VDAKYAKEERFAWAEIHKLPNLTIDQMAAFITKLFDDPSQSSELLSEAKKLNDSQAPK

SEQ ID NO: 980 - protein, 58 aa, ARTIFICIAL SEQUENCE
  Engineered IL-6 binding polypeptide
VDAKYAKEEYAAWFEIHLLPNLTIDQMAAFISKLFDDPSQSSELLSEAKKLNDSQAPK

SEQ ID NO: 981 - protein, 58 aa, ARTIFICIAL SEQUENCE
  Engineered IL-6 binding polypeptide
VDAKYAKEEYDAWFEIHLLPNLTIDQMAAFISKLFDDPSQSSELLSEAKKLNDSQAPK

SEQ ID NO: 982 - protein, 58 aa, ARTIFICIAL SEQUENCE
  Engineered IL-6 binding polypeptide
VDAKYAKEEWEAWMEIHALPNLTVDQMAAFITKLFDDPSQSSELLSEAKKLNDSQAPK

SEQ ID NO: 983 - protein, 58 aa, ARTIFICIAL SEQUENCE
  Engineered IL-6 binding polypeptide
VDAKYAKEEKDAWWEIHALPNLTIEQMAAFITKLFDDPSQSSELLSEAKKLNDSQAPK

SEQ ID NO: 984 - protein, 58 aa, ARTIFICIAL SEQUENCE
  Engineered IL-6 binding polypeptide
VDAKYAKEERDAWFEIHSLPNLTVDQMAAFITKLFDDPSQSSELLSEAKKLNDSQAPK

SEQ ID NO: 985 - protein, 58 aa, ARTIFICIAL SEQUENCE
  Engineered IL-6 binding polypeptide
VDAKYAKEEFYAWLEIHKLPNLTVSQMAAFITKLFDDPSQSSELLSEAKKLNDSQAPK

SEQ ID NO: 986 - protein, 58 aa, ARTIFICIAL SEQUENCE
  Engineered IL-6 binding polypeptide
VDAKYAKEEYEAWYEIHILPNLTVDQMAAFITKLFDDPSQSSELLSEAKKLNDSQAPK

SEQ ID NO: 987 - protein, 58 aa, ARTIFICIAL SEQUENCE
  Engineered IL-6 binding polypeptide
VDAKYAKEERDAWFEIHLLPNLTVNQMAAFITKLFDDPSQSSELLSEAKKLNDSQAPK

SEQ ID NO: 988 - protein, 58 aa, ARTIFICIAL SEQUENCE
  Engineered IL-6 binding polypeptide
VDAKYAKEEYRAWTEIHILPNLTITQIAAFITKLFDDPSQSSELLSEAKKLNDSQAPK

SEQ ID NO: 989 - protein, 58 aa, ARTIFICIAL SEQUENCE
  Engineered IL-6 binding polypeptide
VDAKYAKEEYEAWTEIHLLPNLTIEQMAAFISKLFDDPSQSSELLSEAKKLNDSQAPK

SEQ ID NO: 990 - protein, 58 aa, ARTIFICIAL SEQUENCE
  Engineered IL-6 binding polypeptide
VDAKYAKEEYDAWLEIHILPNLTVEQIAAFITKLFDDPSQSSELLSEAKKLNDSQAPK

SEQ ID NO: 991 - protein, 58 aa, ARTIFICIAL SEQUENCE
  Engineered IL-6 binding polypeptide
VDAKYAKEERKAWYEIHSLPNLTVDQMAAFITKLFDDPSQSSELLSEAKKLNDSQAPK

SEQ ID NO: 992 - protein, 58 aa, ARTIFICIAL SEQUENCE
  Engineered IL-6 binding polypeptide
VDAKYAKEEHTAWTEIHRLPNLTIEQMAAFITKLFDDPSQSSELLSEAKKLNDSQAPK

SEQ ID NO: 993 - protein, 58 aa, ARTIFICIAL SEQUENCE
  Engineered IL-6 binding polypeptide
VDAKYAKEEYQAWTEIHLLPNLTVEQMAAFITKLFDDPSQSSELLSEAKKLNDSQAPK

SEQ ID NO: 994 - protein, 58 aa, ARTIFICIAL SEQUENCE
  Engineered IL-6 binding polypeptide
VDAKYAKEERMAWFEIHSLPNLTVDQMAAFITKLFDDPSQSSELLSEAKKLNDSQAPK

SEQ ID NO: 995 - protein, 58 aa, ARTIFICIAL SEQUENCE
  Engineered IL-6 binding polypeptide
VDAKYAKEEYDAWYEIHILPNLTVEQIAAFITKLFDDPSQSSELLSEAKKLNDSQAPK

SEQ ID NO: 996 - protein, 58 aa, ARTIFICIAL SEQUENCE
  Engineered IL-6 binding polypeptide
VDAKYAKEEKEAWMEIHLLPNLTIDQMAAFITKLFDDPSQSSELLSEAKKLNDSQAPK

SEQ ID NO: 997 - protein, 58 aa, ARTIFICIAL SEQUENCE
  Engineered IL-6 binding polypeptide
VDAKYAKEEYDAWFEIHSLPNLTVNQMAAFITKLFDDPSQSSELLSEAKKLNDSQAPK

SEQ ID NO: 998 - protein, 58 aa, ARTIFICIAL SEQUENCE
  Engineered IL-6 binding polypeptide
VDAKYAKEEAFAWREIHILPNLTIDQMAAFITKLFDDPSQSSELLSEAKKLNDSQAPK

SEQ ID NO: 999 - protein, 58 aa, ARTIFICIAL SEQUENCE
  Engineered IL-6 binding polypeptide
VDAKYAKEERKAWMEIHLLPNLTIEQMAAFITKLFDDPSQSSELLSEAKKLNDSQAPK

SEQ ID NO: 1000 - protein, 58 aa, ARTIFICIAL SEQUENCE
  Engineered IL-6 binding polypeptide
VDAKYAKEEKAAWIEIHNLPNLTVDQMAAFITKLFDDPSQSSELLSEAKKLNDSQAPK

SEQ ID NO: 1001 - protein, 58 aa, ARTIFICIAL SEQUENCE
  Engineered IL-6 binding polypeptide
VDAKYAKEERNAWIEIHNLPNLTIEQMAAFITKLFDDPSQSSELLSEAKKLNDSQAPK

SEQ ID NO: 1002 - protein, 58 aa, ARTIFICIAL SEQUENCE
  Engineered IL-6 binding polypeptide
VDAKYAKEEKNAWTEIHLLPNLTIEQMAAFITKLFDDPSQSSELLSEAKKLNDSQAPK

SEQ ID NO: 1003 - protein, 58 aa, ARTIFICIAL SEQUENCE
  Engineered IL-6 binding polypeptide
VDAKYAKEEAEAWWEIHILPNLTIDQMAAFITKLFDDPSQSSELLSEAKKLNDSQAPK

SEQ ID NO: 1004 - protein, 58 aa, ARTIFICIAL SEQUENCE
  Engineered IL-6 binding polypeptide
VDAKYAKEEKLAWWEIHKLPNLTVDQMAAFITKLFDDPSQSSELLSEAKKLNDSQAPK

SEQ ID NO: 1005 - protein, 58 aa, ARTIFICIAL SEQUENCE
  Engineered IL-6 binding polypeptide
VDAKYAKEEYEAWYEIHILPNLTIHQMAAFITKLFDDPSQSSELLSEAKKLNDSQAPK

SEQ ID NO: 1006 - protein, 58 aa, ARTIFICIAL SEQUENCE
  Engineered IL-6 binding polypeptide
VDAKYAKEEARAWKEIHLLPNLTVGQIAAFITKLFDDPSQSSELLSEAKKLNDSQAPK

SEQ ID NO: 1007 - protein, 58 aa, ARTIFICIAL SEQUENCE
  Engineered IL-6 binding polypeptide
VDAKYAKEEKQAWMEIHLLPNLTVDQMAAFITKLFDDPSQSSELLSEAKKLNDSQAPK

SEQ ID NO: 1008 - protein, 58 aa, ARTIFICIAL SEQUENCE
  Engineered IL-6 binding polypeptide
VDAKYAKEEAAAWHEIHILPNLTVHQIAAFITKLFDDPSQSSELLSEAKKLNDSQAPK

SEQ ID NO: 1009 - protein, 58 aa, ARTIFICIAL SEQUENCE
  Engineered IL-6 binding polypeptide
VDAKYAKEEKEAWFEIHKLPNLTVSQMAAFITKLFDDPSQSSELLSEAKKLNDSQAPK

SEQ ID NO: 1010 - protein, 58 aa, ARTIFICIAL SEQUENCE
  Engineered IL-6 binding polypeptide
VDAKYAKEEKEAWFEIHTLPNLTVDQMAAFISKLFDDPSQSSELLSEAKKLNDSQAPK

SEQ ID NO: 1011 - protein, 58 aa, ARTIFICIAL SEQUENCE
  Engineered IL-6 binding polypeptide
VDAKYAKEEYLAWVEIHNLPNLTIDQMAAFITKLFDDPSQSSELLSEAKKLNDSQAPK

SEQ ID NO: 1012 - protein, 58 aa, ARTIFICIAL SEQUENCE
  Engineered IL-6 binding polypeptide
VDAKYAKEERDAWYEIHNLPNLTVGQMAAFITKLFDDPSQSSELLSEAKKLNDSQAPK

SEQ ID NO: 1013 - protein, 58 aa, ARTIFICIAL SEQUENCE
  Engineered IL-6 binding polypeptide
VDAKYAKEESAAWFEIHLLPNLTINQMAAFITKLFDDPSQSSELLSEAKKLNDSQAPK

SEQ ID NO: 1014 - protein, 58 aa, ARTIFICIAL SEQUENCE
  Engineered IL-6 binding polypeptide
VDAKYAKEEQYAWTEIHILPNLTVNQIAAFITKLFDDPSQSSELLSEAKKLNDSQAPK

SEQ ID NO: 1015 - protein, 58 aa, ARTIFICIAL SEQUENCE
  Engineered IL-6 binding polypeptide
VDAKYAKEEKRAWMEIHLLPNLTVSQMAAFITKLFDDPSQSSELLSEAKKLNDSQAPK

SEQ ID NO: 1016 - protein, 58 aa, ARTIFICIAL SEQUENCE
  Engineered IL-6 binding polypeptide
VDAKYAKEEKKAWFEIHLLPNLTIHQVAAFISKLFDDPSQSSELLSEAKKLNDSQAPK

SEQ ID NO: 1017 - protein, 58 aa, ARTIFICIAL SEQUENCE
  Engineered IL-6 binding polypeptide
VDAKYAKEEKEAWYEIHSLPNLTVDQVAAFITKLFDDPSQSSELLSEAKKLNDSQAPK

SEQ ID NO: 1018 - protein, 58 aa, ARTIFICIAL SEQUENCE
  Engineered IL-6 binding polypeptide
VDAKYAKEEWLAWNEIHLLPNLTISQIAAFISKLFDDPSQSSELLSEAKKLNDSQAPK

SEQ ID NO: 1019 - protein, 58 aa, ARTIFICIAL SEQUENCE
  Engineered IL-6 binding polypeptide
VDAKYAKEEYNAWLEIHILPNLTVHQIAAFISKLFDDPSQSSELLSEAKKLNDSQAPK

SEQ ID NO: 1020 - protein, 58 aa, ARTIFICIAL SEQUENCE
  Engineered IL-6 binding polypeptide
VDAKYAKEEHTAWMEIHRLPNLTIDQIAAFISKLFDDPSQSSELLSEAKKLNDSQAPK

SEQ ID NO: 1021 - protein, 58 aa, ARTIFICIAL SEQUENCE
  Engineered IL-6 binding polypeptide
VDAKYAKEEKFAWTEIHLLPNLTVHQMAAFITKLFDDPSQSSELLSEAKKLNDSQAPK

SEQ ID NO: 1022 - protein, 58 aa, ARTIFICIAL SEQUENCE
  Engineered IL-6 binding polypeptide
VDAKYAKEEKYAWTEIHILPNLTVNQMAAFITKLFDDPSQSSELLSEAKKLNDSQAPK

SEQ ID NO: 1023 - protein, 58 aa, ARTIFICIAL SEQUENCE
  Engineered IL-6 binding polypeptide
VDAKYAKEEKFAWHEIHKLPNLTVDQIAAFITKLFDDPSQSSELLSEAKKLNDSQAPK

SEQ ID NO: 1024 - protein, 58 aa, ARTIFICIAL SEQUENCE
  Engineered IL-6 binding polypeptide
VDAKYAKEERKAWYEIHGLPNLTVEQMAAFITKLFDDPSQSSELLSEAKKLNDSQAPK

SEQ ID NO: 1025 - protein, 58 aa, ARTIFICIAL SEQUENCE
  Engineered IL-6 binding polypeptide
VDAKYAKEEYQAWLEIHLLPNLTVDQIAAFITKLFDDPSQSSELLSEAKKLNDSQAPK

SEQ ID NO: 1026 - protein, 58 aa, ARTIFICIAL SEQUENCE
  Engineered IL-6 binding polypeptide
VDAKYAKEEKHAWMEIHLLPNLTVEQMAAFITKLFDDPSQSSELLSEAKKLNDSQAPK

SEQ ID NO: 1027 - protein, 58 aa, ARTIFICIAL SEQUENCE
  Engineered IL-6 binding polypeptide
VDAKYAKEEKQAWREIHLLPNLTVDQIAAFISKLFDDPSQSSELLSEAKKLNDSQAPK

SEQ ID NO: 1028 - protein, 58 aa, ARTIFICIAL SEQUENCE
  Engineered IL-6 binding polypeptide
VDAKYAKEEAMAWTEIHLLPNLTVSQMAAFITKLFDDPSQSSELLSEAKKLNDSQAPK

SEQ ID NO: 1029 - protein, 58 aa, ARTIFICIAL SEQUENCE
  Engineered IL-6 binding polypeptide
VDAKYAKEEKHAWREIHLLPNLTLNQMAAFITKLFDDPSQSSELLSEAKKLNDSQAPK

SEQ ID NO: 1030 - protein, 58 aa, ARTIFICIAL SEQUENCE
  Engineered IL-6 binding polypeptide
VDAKYAKEERYAWNEIHALPNLTVEQVAAFITKLFDDPSQSSELLSEAKKLNDSQAPK

SEQ ID NO: 1031 - protein, 58 aa, ARTIFICIAL SEQUENCE
  Engineered IL-6 binding polypeptide
VDAKYAKEEREAWWEIHKLPNLTVDQMAAFISKLFDDPSQSSELLSEAKKLNDSQAPK

SEQ ID NO: 1032 - protein, 58 aa, ARTIFICIAL SEQUENCE
  Engineered IL-6 binding polypeptide
VDAKYAKEEHRAWTEIHLLPNLTVDQMAAFISKLFDDPSQSSELLSEAKKLNDSQAPK

SEQ ID NO: 1033 - protein, 58 aa, ARTIFICIAL SEQUENCE
  Engineered IL-6 binding polypeptide
VDAKYAKEEAYAWAEIHKLPNLTVVQMAAFISKLFDDPSQSSELLSEAKKLNDSQAPK

SEQ ID NO: 1034 - protein, 58 aa, ARTIFICIAL SEQUENCE
  Engineered IL-6 binding polypeptide
VDAKYAKEEYFAWTEIHKLPNLTIDQIAAFITKLFDDPSQSSELLSEAKKLNDSQAPK

SEQ ID NO: 1035 - protein, 58 aa, ARTIFICIAL SEQUENCE
  Engineered IL-6 binding polypeptide
VDAKYAKEEAHAWQEIHKLPNLTINQIAAFISKLFDDPSQSSELLSEAKKLNDSQAPK

SEQ ID NO: 1036 - protein, 58 aa, ARTIFICIAL SEQUENCE
  Engineered IL-6 binding polypeptide
VDAKYAKEEKHAWTEIHKLPNLTIDQMAAFITKLFDDPSQSSELLSEAKKLNDSQAPK

SEQ ID NO: 1037 - protein, 58 aa, ARTIFICIAL SEQUENCE
  Engineered IL-6 binding polypeptide
VDAKYAKEEYRAWYEIHILPNLTVKQMAAFITKLFDDPSQSSELLSEAKKLNDSQAPK

SEQ ID NO: 1038 - protein, 58 aa, ARTIFICIAL SEQUENCE
  Engineered IL-6 binding polypeptide
VDAKYAKEEANAWIEIHKLPNLTVDQMAAFITKLFDDPSQSSELLSEAKKLNDSQAPK

SEQ ID NO: 1039 - protein, 58 aa, ARTIFICIAL SEQUENCE
  Engineered IL-6 binding polypeptide
VDAKYAKEEKDAWTEIHKLPNLTIDQMAAFITKLFDDPSQSSELLSEAKKLNDSQAPK

SEQ ID NO: 1040 - protein, 58 aa, ARTIFICIAL SEQUENCE
  Engineered IL-6 binding polypeptide
VDAKYAKEEREAWYEIHNLPNLTIIQMAAFISKLFDDPSQSSELLSEAKKLNDSQAPK

SEQ ID NO: 1041 - protein, 58 aa, ARTIFICIAL SEQUENCE
  Engineered IL-6 binding polypeptide
VDAKYAKEEYYAWNEIHLLPNLTIEQMAAFITKLFDDPSQSSELLSEAKKLNDSQAPK

SEQ ID NO: 1042 - protein, 58 aa, ARTIFICIAL SEQUENCE
  Engineered IL-6 binding polypeptide
VDAKYAKEEKTAWREIHLLPNLTIDQIAAFITKLFDDPSQSSELLSEAKKLNDSQAPK

SEQ ID NO: 1043 - protein, 58 aa, ARTIFICIAL SEQUENCE
  Engineered IL-6 binding polypeptide
VDAKYAKEEAHAWREIHILPNLTLDQMAAFITKLFDDPSQSSELLSEAKKLNDSQAPK

SEQ ID NO: 1044 - protein, 58 aa, ARTIFICIAL SEQUENCE
  Engineered IL-6 binding polypeptide
VDAKYAKEEAAAWLEIHQLPNLTVDQMAAFITKLFDDPSQSSELLSEAKKLNDSQAPK

SEQ ID NO: 1045 - protein, 58 aa, ARTIFICIAL SEQUENCE
  Engineered IL-6 binding polypeptide
VDAKYAKEEAEAWLEIHILPNLTVEQMAAFITKLFDDPSQSSELLSEAKKLNDSQAPK

SEQ ID NO: 1046 - protein, 58 aa, ARTIFICIAL SEQUENCE
  Engineered IL-6 binding polypeptide
VDAKYAKEEANAWFEIHILPNLTVQQMAAFITKLFDDPSQSSELLSEAKKLNDSQAPK

SEQ ID NO: 1047 - protein, 58 aa, ARTIFICIAL SEQUENCE
  Engineered IL-6 binding polypeptide
VDAKYAKEERYAWMEIHLLPNLTINQMAAFITKLFDDPSQSSELLSEAKKLNDSQAPK

SEQ ID NO: 1048 - protein, 58 aa, ARTIFICIAL SEQUENCE
  Engineered IL-6 binding polypeptide
VDAKYAKEERFAWNEIHKLPNLTIDQMAAFITKLFDDPSQSSELLSEAKKLNDSQAPK

SEQ ID NO: 1049 - protein, 58 aa, ARTIFICIAL SEQUENCE
  Engineered IL-6 binding polypeptide
VDAKYAKEEAKAWFEIHLLPNLTIQQIAAFITKLFDDPSQSSELLSEAKKLNDSQAPK

SEQ ID NO: 1050 - protein, 58 aa, ARTIFICIAL SEQUENCE
  Engineered IL-6 binding polypeptide
VDAKYAKEEREAWTEIHILPNLTIDQMAAFITKLFDDPSQSSELLSEAKKLNDSQAPK

SEQ ID NO: 1051 - protein, 58 aa, ARTIFICIAL SEQUENCE
  Engineered IL-6 binding polypeptide
VDAKYAKEEFEAWNEIHKLPNLTIEQMAAFISKLFDDPSQSSELLSEAKKLNDSQAPK

SEQ ID NO: 1052 - protein, 58 aa, ARTIFICIAL SEQUENCE
  Engineered IL-6 binding polypeptide
VDAKYAKEEKEAWYEIHILPNLTVHQIAAFISKLFDDPSQSSELLSEAKKLNDSQAPK

SEQ ID NO: 1053 - protein, 58 aa, ARTIFICIAL SEQUENCE
  Engineered IL-6 binding polypeptide
VDAKYAKEEYQAWVEIHNLPNLTVDQMAAFITKLFDDPSQSSELLSEAKKLNDSQAPK

SEQ ID NO: 1054 - protein, 58 aa, ARTIFICIAL SEQUENCE
  Engineered IL-6 binding polypeptide
VDAKYAKEEKKAWREIHLLPNLTINQIAAFITKLFDDPSQSSELLSEAKKLNDSQAPK

SEQ ID NO: 1055 - protein, 58 aa, ARTIFICIAL SEQUENCE
  Engineered IL-6 binding polypeptide
VDAKYAKEEQDAWIEIHLLPNLTIDQMAAFITKLFDDPSQSSELLSEAKKLNDSQAPK

SEQ ID NO: 1056 - protein, 58 aa, ARTIFICIAL SEQUENCE
  Engineered IL-6 binding polypeptide
VDAKYAKEEHDAWWEIHALPNLTINQMAAFISKLFDDPSQSSELLSEAKKLNDSQAPK

SEQ ID NO: 1057 - protein, 58 aa, ARTIFICIAL SEQUENCE
  Engineered IL-6 binding polypeptide
VDAKYAKEEYDAWYEIHLLPNLTIQQMAAFISKLFDDPSQSSELLSEAKKLNDSQAPK

SEQ ID NO: 1058 - protein, 58 aa, ARTIFICIAL SEQUENCE
  Engineered IL-6 binding polypeptide
VDAKYAKEEYQAWVEIHILPNLTIQQIAAFITKLFDDPSQSSELLSEAKKLNDSQAPK

SEQ ID NO: 1059 - protein, 58 aa, ARTIFICIAL SEQUENCE
  Engineered IL-6 binding polypeptide
VDAKYAKEESKAWNEIHKLPNLTITQMAAFITKLFDDPSQSSELLSEAKKLNDSQAPK

SEQ ID NO: 1060 - protein, 58 aa, ARTIFICIAL SEQUENCE
  Engineered IL-6 binding polypeptide
VDAKYAKEEYQAWYEIHLLPNLTVEQMAAFITKLFDDPSQSSELLSEAKKLNDSQAPK

SEQ ID NO: 1061 - protein, 58 aa, ARTIFICIAL SEQUENCE
  Engineered IL-6 binding polypeptide
VDAKYAKEEKRAWMEIHLLPNLTVGQMAAFITKLFDDPSQSSELLSEAKKLNDSQAPK

SEQ ID NO: 1062 - protein, 58 aa, ARTIFICIAL SEQUENCE
  Engineered IL-6 binding polypeptide
VDAKYAKEERVAWLEIHILPNLTIGQIAAFITKLFDDPSQSSELLSEAKKLNDSQAPK

SEQ ID NO: 1063 - protein, 58 aa, ARTIFICIAL SEQUENCE
  Engineered IL-6 binding polypeptide
VDAKYAKEEQAAWYEIHLLPNLTIEQMAAFITKLFDDPSQSSELLSEAKKLNDSQAPK

SEQ ID NO: 1064 - protein, 58 aa, ARTIFICIAL SEQUENCE
  Engineered IL-6 binding polypeptide
VDAKYAKEEKDAWYEIHILPNLTVSQIAAFITKLFDDPSQSSELLSEAKKLNDSQAPK

SEQ ID NO: 1065 - protein, 58 aa, ARTIFICIAL SEQUENCE
  Engineered IL-6 binding polypeptide
VDAKYAKEEKKAWYEIHLLPNLTISQMAAFITKLFDDPSQSSELLSEAKKLNDSQAPK

SEQ ID NO: 1066 - protein, 58 aa, ARTIFICIAL SEQUENCE
  Engineered IL-6 binding polypeptide
VDAKYAKEEKKAWYEIHLLPNLTINQMAAFITKLFDDPSQSSELLSEAKKLNDSQAPK

SEQ ID NO: 1067 - protein, 58 aa, ARTIFICIAL SEQUENCE
  Engineered IL-6 binding polypeptide
VDAKYAKEEHKAWTEIHLLPNLTVDQIAAFITKLFDDPSQSSELLSEAKKLNDSQAPK

SEQ ID NO: 1068 - protein, 58 aa, ARTIFICIAL SEQUENCE
  Engineered IL-6 binding polypeptide
VDAKYAKEEAAAWHEIHLLPNLTIDQMAAFITKLFDDPSQSSELLSEAKKLNDSQAPK

SEQ ID NO: 1069 - protein, 58 aa, ARTIFICIAL SEQUENCE
  Engineered IL-6 binding polypeptide
VDAKYAKEERSAWTEIHLLPNLTITQIAAFITKLFDDPSQSSELLSEAKKLNDSQAPK

SEQ ID NO: 1070 - protein, 58 aa, ARTIFICIAL SEQUENCE
  Engineered IL-6 binding polypeptide
VDAKYAKEERLAWQEIHRLPNLTVDQMAAFITKLFDDPSQSSELLSEAKKLNDSQAPK

SEQ ID NO: 1071 - protein, 58 aa, ARTIFICIAL SEQUENCE
  Engineered IL-6 binding polypeptide
VDAKYAKEEKDAWTEIHLLPNLTVEQMAAFISKLFDDPSQSSELLSEAKKLNDSQAPK

SEQ ID NO: 1072 - protein, 58 aa, ARTIFICIAL SEQUENCE
  Engineered IL-6 binding polypeptide
VDAKYAKEEKAAWMEIHNLPNLTIDQMAAFITKLFDDPSQSSELLSEAKKLNDSQAPK

SEQ ID NO: 1073 - protein, 58 aa, ARTIFICIAL SEQUENCE
  Engineered IL-6 binding polypeptide
VDAKYAKEEYEAWVEIHNLPNLTIDQMAAFITKLFDDPSQSSELLSEAKKLNDSQAPK

SEQ ID NO: 1074 - protein, 58 aa, ARTIFICIAL SEQUENCE
  Engineered IL-6 binding polypeptide
VDAKYAKEEAKAWTEIHLLPNLTVNQIAAFITKLFDDPSQSSELLSEAKKLNDSQAPK

SEQ ID NO: 1075 - protein, 58 aa, ARTIFICIAL SEQUENCE
  Engineered IL-6 binding polypeptide
VDAKYAKEEKKAWYEIHILPNLTIHQIAAFITKLFDDPSQSSELLSEAKKLNDSQAPK

SEQ ID NO: 1076 - protein, 58 aa, ARTIFICIAL SEQUENCE
  Engineered IL-6 binding polypeptide
VDAKYAKEEKKAWFEIHLLPNLTVDQMAAFISKLFDDPSQSSELLSEAKKLNDSQAPK

SEQ ID NO: 1077 - protein, 58 aa, ARTIFICIAL SEQUENCE
  Engineered IL-6 binding polypeptide
VDAKYAKEERKAWFEIHSLPNLTIDQMAAFITKLFDDPSQSSELLSEAKKLNDSQAPK

SEQ ID NO: 1078 - protein, 58 aa, ARTIFICIAL SEQUENCE
  Engineered IL-6 binding polypeptide
VDAKYAKEERNAWYEIHLLPNLTVDQMAAFITKLFDDPSQSSELLSEAKKLNDSQAPK

SEQ ID NO: 1079 - protein, 58 aa, ARTIFICIAL SEQUENCE
  Engineered IL-6 binding polypeptide
VDAKYAKEEASAWKEIHLLPNLTIDQVAAFITKLFDDPSQSSELLSEAKKLNDSQAPK

SEQ ID NO: 1080 - protein, 58 aa, ARTIFICIAL SEQUENCE
  Engineered IL-6 binding polypeptide
VDAKYAKEEAAAWKEIHLLPNLTIDQMAAFISKLFDDPSQSSELLSEAKKLNDSQAPK

SEQ ID NO: 1081 - protein, 58 aa, ARTIFICIAL SEQUENCE
  Engineered IL-6 binding polypeptide
VDAKYAKEEAWAWHEIHILPNLTIEQMAAFITKLFDDPSQSSELLSEAKKLNDSQAPK

SEQ ID NO: 1082 - protein, 58 aa, ARTIFICIAL SEQUENCE
  Engineered IL-6 binding polypeptide
VDAKYAKEEKYAWLEIHKLPNLTVDQVAAFITKLFDDPSQSSELLSEAKKLNDSQAPK

SEQ ID NO: 1083 - protein, 58 aa, ARTIFICIAL SEQUENCE
  Engineered IL-6 binding polypeptide
VDAKYAKEERSAWMEIHLLPNLTINQMAAFISKLFDDPSQSSELLSEAKKLNDSQAPK

SEQ ID NO: 1084 - protein, 58 aa, ARTIFICIAL SEQUENCE
  Engineered IL-6 binding polypeptide
VDAKYAKEERMAWNEIHGLPNLTVDQMAAFITKLFDDPSQSSELLSEAKKLNDSQAPK

SEQ ID NO: 1085 - protein, 58 aa, ARTIFICIAL SEQUENCE
  Engineered IL-6 binding polypeptide
VDAKYAKEEAKAWYEIHILPNLTIIQMAAFITKLFDDPSQSSELLSEAKKLNDSQAPK

SEQ ID NO: 1086 - protein, 58 aa, ARTIFICIAL SEQUENCE
  Engineered IL-6 binding polypeptide
VDAKYAKEEKWAWTEIHKLPNLTISQMAAFITKLFDDPSQSSELLSEAKKLNDSQAPK

SEQ ID NO: 1087 - protein, 58 aa, ARTIFICIAL SEQUENCE
  Engineered IL-6 binding polypeptide
VDAKYAKEERMAWTEIHNLPNLTIEQMAAFITKLFDDPSQSSELLSEAKKLNDSQAPK

SEQ ID NO: 1088 - protein, 58 aa, ARTIFICIAL SEQUENCE
  Engineered IL-6 binding polypeptide
VDAKYAKEEEWAWKEIHILPNLTVEQVAAFITKLFDDPSQSSELLSEAKKLNDSQAPK

SEQ ID NO: 1089 - protein, 58 aa, ARTIFICIAL SEQUENCE
  Engineered IL-6 binding polypeptide
VDAKYAKEEKFAWTEIHKLPNLTVDQMAAFITKLFDDPSQSSELLSEAKKLNDSQAPK

SEQ ID NO: 1090 - protein, 58 aa, ARTIFICIAL SEQUENCE
  Engineered IL-6 binding polypeptide
VDAKYAKEEHYAWQEIHKLPNLTIDQMAAFITKLFDDPSQSSELLSEAKKLNDSQAPK

SEQ ID NO: 1091 - protein, 58 aa, ARTIFICIAL SEQUENCE
  Engineered IL-6 binding polypeptide
VDAKYAKEERKAWYEIHILPNLTITQIAAFITKLFDDPSQSSELLSEAKKLNDSQAPK

SEQ ID NO: 1092 - protein, 58 aa, ARTIFICIAL SEQUENCE
  Engineered IL-6 binding polypeptide
VDAKYAKEERYAWTEIHKLPNLTVDQVAAFISKLFDDPSQSSELLSEAKKLNDSQAPK

SEQ ID NO: 1093 - protein, 58 aa, ARTIFICIAL SEQUENCE
  Engineered IL-6 binding polypeptide
VDAKYAKEEKEAWYEIHILPNLTVSQIAAFITKLFDDPSQSSELLSEAKKLNDSQAPK

SEQ ID NO: 1094 - protein, 58 aa, ARTIFICIAL SEQUENCE
  Engineered IL-6 binding polypeptide
VDAKYAKEEYSAWFEIHILPNLTVEQMAAFISKLFDDPSQSSELLSEAKKLNDSQAPK

SEQ ID NO: 1095 - protein, 58 aa, ARTIFICIAL SEQUENCE
  Engineered IL-6 binding polypeptide
VDAKYAKEERMAWNEIHKLPNLTIDQMAAFISKLFDDPSQSSELLSEAKKLNDSQAPK

SEQ ID NO: 1096 - protein, 58 aa, ARTIFICIAL SEQUENCE
  Engineered IL-6 binding polypeptide
VDAKYAKEEAKAWTEIHLLPNLTVNQVAAFITKLFDDPSQSSELLSEAKKLNDSQAPK

SEQ ID NO: 1097 - protein, 58 aa, ARTIFICIAL SEQUENCE
  Engineered IL-6 binding polypeptide
VDAKYAKEEKFAWREIHLLPNLTIEQMAAFISKLFDDPSQSSELLSEAKKLNDSQAPK

SEQ ID NO: 1098 - protein, 58 aa, ARTIFICIAL SEQUENCE
  Engineered IL-6 binding polypeptide
VDAKYAKEEANAWHEIHLLPNLTIDQMAAFITKLFDDPSQSSELLSEAKKLNDSQAPK

SEQ ID NO: 1099 - protein, 58 aa, ARTIFICIAL SEQUENCE
  Engineered IL-6 binding polypeptide
VDAKYAKEEKHAWNEIHRLPNLTVEQMAAFITKLFDDPSQSSELLSEAKKLNDSQAPK

SEQ ID NO: 1100 - protein, 58 aa, ARTIFICIAL SEQUENCE
  Engineered IL-6 binding polypeptide
VDAKYAKEEHMAWTEIHALPNLTVDQMAAFISKLFDDPSQSSELLSEAKKLNDSQAPK

SEQ ID NO: 1101 - protein, 58 aa, ARTIFICIAL SEQUENCE
  Engineered IL-6 binding polypeptide
VDAKYAKEEYEAWMEIHNLPNLTVDQMAAFITKLFDDPSQSSELLSEAKKLNDSQAPK

SEQ ID NO: 1102 - protein, 58 aa, ARTIFICIAL SEQUENCE
  Engineered IL-6 binding polypeptide
VDAKYAKEERAAWYEIHILPNLTVEQMAAFITKLFDDPSQSSELLSEAKKLNDSQAPK

SEQ ID NO: 1103 - protein, 58 aa, ARTIFICIAL SEQUENCE
  Engineered IL-6 binding polypeptide
VDAKYAKEEKNAWYEIHLLPNLTVVQMAAFITKLFDDPSQSSELLSEAKKLNDSQAPK

SEQ ID NO: 1104 - protein, 58 aa, ARTIFICIAL SEQUENCE
  Engineered IL-6 binding polypeptide
VDAKYAKEEQIAWYEIHILPNLTVDQVAAFISKLFDDPSQSSELLSEAKKLNDSQAPK

SEQ ID NO: 1105 - protein, 58 aa, ARTIFICIAL SEQUENCE
  Engineered IL-6 binding polypeptide
VDAKYAKEEYYAWTEIHRLPNLTVDQMAAFITKLFDDPSQSSELLSEAKKLNDSQAPK

SEQ ID NO: 1106 - protein, 58 aa, ARTIFICIAL SEQUENCE
  Engineered IL-6 binding polypeptide
VDAKYAKEEADAWFEIHILPNLTVDQIAAFITKLFDDPSQSSELLSEAKKLNDSQAPK

SEQ ID NO: 1107 - protein, 58 aa, ARTIFICIAL SEQUENCE
  Engineered IL-6 binding polypeptide
VDAKYAKEEKEAWMEIHKLPNLTVDQMAAFITKLFDDPSQSSELLSEAKKLNDSQAPK

SEQ ID NO: 1108 - protein, 58 aa, ARTIFICIAL SEQUENCE
  Engineered IL-6 binding polypeptide
VDAKYAKEEYLAWIEIHALPNLTVSQMAAFITKLFDDPSQSSELLSEAKKLNDSQAPK

SEQ ID NO: 1109 - protein, 58 aa, ARTIFICIAL SEQUENCE
  Engineered IL-6 binding polypeptide
VDAKYAKEEAFAWWEIHKLPNLTINQMAAFITKLFDDPSQSSELLSEAKKLNDSQAPK

SEQ ID NO: 1110 - protein, 58 aa, ARTIFICIAL SEQUENCE
  Engineered IL-6 binding polypeptide
VDAKYAKEEYNAWFEIHILPNLTISQMAAFITKLFDDPSQSSELLSEAKKLNDSQAPK

SEQ ID NO: 1111 - protein, 58 aa, ARTIFICIAL SEQUENCE
  Engineered IL-6 binding polypeptide
VDAKYAKEEKEAWREIHILPNLTVDQMAAFISKLFDDPSQSSELLSEAKKLNDSQAPK

SEQ ID NO: 1112 - protein, 58 aa, ARTIFICIAL SEQUENCE
  Engineered IL-6 binding polypeptide
VDAKYAKEEKKAWHEIHILPNLTIGQMAAFISKLFDDPSQSSELLSEAKKLNDSQAPK

SEQ ID NO: 1113 - protein, 58 aa, ARTIFICIAL SEQUENCE
  Engineered IL-6 binding polypeptide
VDAKYAKEEYHAWTEIHKLPNLTINQMAAFISKLFDDPSQSSELLSEAKKLNDSQAPK

SEQ ID NO: 1114 - protein, 58 aa, ARTIFICIAL SEQUENCE
  Engineered IL-6 binding polypeptide
VDAKYAKEEFSAWYEIHLLPNLTVDQMAAFITKLFDDPSQSSELLSEAKKLNDSQAPK

SEQ ID NO: 1115 - protein, 58 aa, ARTIFICIAL SEQUENCE
  Engineered IL-6 binding polypeptide
VDAKYAKEERAAWWEIHTLPNLTVDQMAAFISKLFDDPSQSSELLSEAKKLNDSQAPK

SEQ ID NO: 1116 - protein, 58 aa, ARTIFICIAL SEQUENCE
  Engineered IL-6 binding polypeptide
VDAKYAKEEYEAWVEIHLLPNLTIDQMAAFISKLFDDPSQSSELLSEAKKLNDSQAPK

SEQ ID NO: 1117 - protein, 58 aa, ARTIFICIAL SEQUENCE
  Engineered IL-6 binding polypeptide
VDAKYAKEEAEAWVEIHLLPNLTVNQMAAFITKLFDDPSQSSELLSEAKKLNDSQAPK

SEQ ID NO: 1118 - protein, 58 aa, ARTIFICIAL SEQUENCE
  Engineered IL-6 binding polypeptide
VDAKYAKEEAKAWHEIHILPNLTITQIAAFITKLFDDPSQSSELLSEAKKLNDSQAPK

SEQ ID NO: 1119 - protein, 58 aa, ARTIFICIAL SEQUENCE
  Engineered IL-6 binding polypeptide
VDAKYAKEEFYAWNEIHKLPNLTVNQMAAFITKLFDDPSQSSELLSEAKKLNDSQAPK

SEQ ID NO: 1120 - protein, 58 aa, ARTIFICIAL SEQUENCE
  Engineered IL-6 binding polypeptide
VDAKYAKEEYLAWTEIHLLPNLTIEQMAAFITKLFDDPSQSSELLSEAKKLNDSQAPK

SEQ ID NO: 1121 - protein, 58 aa, ARTIFICIAL SEQUENCE
  Engineered IL-6 binding polypeptide
VDAKYAKEEHAAWREIHALPNLTVDQMAAFISKLFDDPSQSSELLSEAKKLNDSQAPK

SEQ ID NO: 1122 - protein, 58 aa, ARTIFICIAL SEQUENCE
  Engineered IL-6 binding polypeptide
VDAKYAKEEQRAWMEIHLLPNLTIEQIAAFISKLFDDPSQSSELLSEAKKLNDSQAPK

SEQ ID NO: 1123 - protein, 58 aa, ARTIFICIAL SEQUENCE
  Engineered IL-6 binding polypeptide
VDAKYAKEERDAWTEIHKLPNLTVDQMAAFITKLFDDPSQSSELLSEAKKLNDSQAPK

SEQ ID NO: 1124 - protein, 58 aa, ARTIFICIAL SEQUENCE
  Engineered IL-6 binding polypeptide
VDAKYAKEERDAWFEIHRLPNLTVDQMAAFITKLFDDPSQSSELLSEAKKLNDSQAPK

SEQ ID NO: 1125 - protein, 58 aa, ARTIFICIAL SEQUENCE
  Engineered IL-6 binding polypeptide
VDAKYAKEESYAWTEIHKLPNLTIDQMAAFITKLFDDPSQSSELLSEAKKLNDSQAPK

SEQ ID NO: 1126 - protein, 58 aa, ARTIFICIAL SEQUENCE
  Engineered IL-6 binding polypeptide
VDAKYAKEEKFAWKEIHILPNLTIDQIAAFITKLFDDPSQSSELLSEAKKLNDSQAPK

SEQ ID NO: 1127 - protein, 58 aa, ARTIFICIAL SEQUENCE
  Engineered IL-6 binding polypeptide
VDAKYAKEEHRAWMEIHQLPNLTVDQMAAFITKLFDDPSQSSELLSEAKKLNDSQAPK

SEQ ID NO: 1128 - protein, 58 aa, ARTIFICIAL SEQUENCE
  Engineered IL-6 binding polypeptide
VDAKYAKEERTAWFEIHKLPNLTVDQMAAFITKLFDDPSQSSELLSEAKKLNDSQAPK

SEQ ID NO: 1129 - protein, 58 aa, ARTIFICIAL SEQUENCE
  Engineered IL-6 binding polypeptide
VDAKYAKEERYAWWEIHKLPNLTVEQVAAFITKLFDDPSQSSELLSEAKKLNDSQAPK

SEQ ID NO: 1130 - protein, 58 aa, ARTIFICIAL SEQUENCE
  Engineered IL-6 binding polypeptide
VDAKYAKEEEEAWNEIHRLPNLTVVQMAAFISKLFDDPSQSSELLSEAKKLNDSQAPK

SEQ ID NO: 1131 - protein, 58 aa, ARTIFICIAL SEQUENCE
  Engineered IL-6 binding polypeptide
VDAKYAKEEYEAWVEIHILPNLTVEQMAAFITKLFDDPSQSSELLSEAKKLNDSQAPK

SEQ ID NO: 1132 - protein, 58 aa, ARTIFICIAL SEQUENCE
  Engineered IL-6 binding polypeptide
VDAKYAKEEYHAWTEIHLLPNLTIEQMAAFITKLFDDPSQSSELLSEAKKLNDSQAPK

SEQ ID NO: 1133 - protein, 58 aa, ARTIFICIAL SEQUENCE
  Engineered IL-6 binding polypeptide
VDAKYAKEEYNAWYEIHVLPNLTIDQIAAFITKLFDDPSQSSELLSEAKKLNDSQAPK

SEQ ID NO: 1134 - protein, 58 aa, ARTIFICIAL SEQUENCE
  Engineered IL-6 binding polypeptide
VDAKYAKEERKAWYEIHILPNLTVHQIAAFITKLFDDPSQSSELLSEAKKLNDSQAPK

SEQ ID NO: 1135 - protein, 58 aa, ARTIFICIAL SEQUENCE
  Engineered IL-6 binding polypeptide
VDAKYAKEEWAAWIEIHSLPNLTVDQMAAFITKLFDDPSQSSELLSEAKKLNDSQAPK

SEQ ID NO: 1136 - protein, 58 aa, ARTIFICIAL SEQUENCE
  Engineered IL-6 binding polypeptide
VDAKYAKEEAIAWSEIHSLPNLTVGQMAAFITKLFDDPSQSSELLSEAKKLNDSQAPK

SEQ ID NO: 1137 - protein, 58 aa, ARTIFICIAL SEQUENCE
  Engineered IL-6 binding polypeptide
VDAKYAKEEKYAWTEIHILPNLTIDQMAAFISKLFDDPSQSSELLSEAKKLNDSQAPK

SEQ ID NO: 1138 - protein, 58 aa, ARTIFICIAL SEQUENCE
  Engineered IL-6 binding polypeptide
VDAKYAKEEHTAWREIHLLPNLTISQMAAFITKLFDDPSQSSELLSEAKKLNDSQAPK

SEQ ID NO: 1139 - protein, 58 aa, ARTIFICIAL SEQUENCE
  Engineered IL-6 binding polypeptide
VDAKYAKEEYTAWYEIHLLPNLTIEQMAAFISKLFDDPSQSSELLSEAKKLNDSQAPK

SEQ ID NO: 1140 - protein, 58 aa, ARTIFICIAL SEQUENCE
  Engineered IL-6 binding polypeptide
VDAKYAKEEYEAWYEIHILPNLTVRQMAAFISKLFDDPSQSSELLSEAKKLNDSQAPK

SEQ ID NO: 1141 - protein, 58 aa, ARTIFICIAL SEQUENCE
  Engineered IL-6 binding polypeptide
VDAKYAKEEKHAWTEIHLLPNLTISQMAAFITKLFDDPSQSSELLSEAKKLNDSQAPK

SEQ ID NO: 1142 - protein, 58 aa, ARTIFICIAL SEQUENCE
  Engineered IL-6 binding polypeptide
VDAKYAKEEYTAWYEIHVLPNLTIRQMAAFITKLFDDPSQSSELLSEAKKLNDSQAPK

SEQ ID NO: 1143 - protein, 58 aa, ARTIFICIAL SEQUENCE
  Engineered IL-6 binding polypeptide
VDAKYAKEEQRAWYEIHTLPNLTIDQMAAFITKLFDDPSQSSELLSEAKKLNDSQAPK

SEQ ID NO: 1144 - protein, 58 aa, ARTIFICIAL SEQUENCE
  Engineered IL-6 binding polypeptide
VDAKYAKEEAVAWKEIHLLPNLTIDQIAAFISKLFDDPSQSSELLSEAKKLNDSQAPK

SEQ ID NO: 1145 - protein, 58 aa, ARTIFICIAL SEQUENCE
  Engineered IL-6 binding polypeptide
VDAKYAKEEYRAWMEIHALPNLTIVQIAAFITKLFDDPSQSSELLSEAKKLNDSQAPK

SEQ ID NO: 1146 - protein, 58 aa, ARTIFICIAL SEQUENCE
  Engineered IL-6 binding polypeptide
VDAKYAKEERSAWNEIHKLPNLTIDQMAAFITKLFDDPSQSSELLSEAKKLNDSQAPK

SEQ ID NO: 1147 - protein, 58 aa, ARTIFICIAL SEQUENCE
  Engineered IL-6 binding polypeptide
VDAKYAKEEAEAWFEIHILPNLTVGQIAAFITKLFDDPSQSSELLSEAKKLNDSQAPK

SEQ ID NO: 1148 - protein, 58 aa, ARTIFICIAL SEQUENCE
  Engineered IL-6 binding polypeptide
VDAKYAKEEKMAWNEIHKLPNLTVEQIAAFITKLFDDPSQSSELLSEAKKLNDSQAPK

SEQ ID NO: 1149 - protein, 58 aa, ARTIFICIAL SEQUENCE
  Engineered IL-6 binding polypeptide
VDAKYAKEERTAWMEIHKLPNLTIDQMAAFISKLFDDPSQSSELLSEAKKLNDSQAPK

SEQ ID NO: 1150 - protein, 58 aa, ARTIFICIAL SEQUENCE
  Engineered IL-6 binding polypeptide
VDAKYAKEEYEAWYEIHALPNLTLHQMAAFISKLFDDPSQSSELLSEAKKLNDSQAPK

SEQ ID NO: 1151 - protein, 58 aa, ARTIFICIAL SEQUENCE
  Engineered IL-6 binding polypeptide
VDAKYAKEEYDAWFEIHVLPNLTVNQMAAFITKLFDDPSQSSELLSEAKKLNDSQAPK

SEQ ID NO: 1152 - protein, 58 aa, ARTIFICIAL SEQUENCE
  Engineered IL-6 binding polypeptide
VDAKYAKEESLAWMEIHKLPNLTVDQVAAFITKLFDDPSQSSELLSEAKKLNDSQAPK

SEQ ID NO: 1153 - protein, 58 aa, ARTIFICIAL SEQUENCE
  Engineered IL-6 binding polypeptide
VDAKYAKEERNAWWEIHALPNLTVNQMAAFITKLFDDPSQSSELLSEAKKLNDSQAPK

SEQ ID NO: 1154 - protein, 58 aa, ARTIFICIAL SEQUENCE
  Engineered IL-6 binding polypeptide
VDAKYAKEEKKAWKEIHLLPNLTVNQMAAFISKLFDDPSQSSELLSEAKKLNDSQAPK

SEQ ID NO: 1155 - protein, 58 aa, ARTIFICIAL SEQUENCE
  Engineered IL-6 binding polypeptide
VDAKYAKEEKYAWTEIHNLPNLTILQMAAFITKLFDDPSQSSELLSEAKKLNDSQAPK

SEQ ID NO: 1156 - protein, 58 aa, ARTIFICIAL SEQUENCE
  Engineered IL-6 binding polypeptide
VDAKYAKEEYKAWVEIHLLPNLTVDQMAAFISKLFDDPSQSSELLSEAKKLNDSQAPK

SEQ ID NO: 1157 - protein, 58 aa, ARTIFICIAL SEQUENCE
  Engineered IL-6 binding polypeptide
VDAKYAKEEHAAWLEIHLLPNLTVSQIAAFITKLFDDPSQSSELLSEAKKLNDSQAPK

SEQ ID NO: 1158 - protein, 58 aa, ARTIFICIAL SEQUENCE
  Engineered IL-6 binding polypeptide
VDAKYAKEEYHAWWEIHALPNLTVEQMAAFITKLFDDPSQSSELLSEAKKLNDSQAPK

SEQ ID NO: 1159 - protein, 58 aa, ARTIFICIAL SEQUENCE
  Engineered IL-6 binding polypeptide
VDAKYAKEERYAWNEIHRLPNLTVDQMAAFITKLFDDPSQSSELLSEAKKLNDSQAPK

SEQ ID NO: 1160 - protein, 58 aa, ARTIFICIAL SEQUENCE
  Engineered IL-6 binding polypeptide
VDAKYAKEEAQAWMEIHLLPNLTIAQMAAFITKLFDDPSQSSELLSEAKKLNDSQAPK

SEQ ID NO: 1161 - protein, 58 aa, ARTIFICIAL SEQUENCE
  Engineered IL-6 binding polypeptide
VDAKYAKEEREAWYEIHILPNLTVNQMAAFITKLFDDPSQSSELLSEAKKLNDSQAPK

SEQ ID NO: 1162 - protein, 58 aa, ARTIFICIAL SEQUENCE
  Engineered IL-6 binding polypeptide
VDAKYAKEEAYAWNEIHKLPNLTVEQMAAFISKLFDDPSQSSELLSEAKKLNDSQAPK

SEQ ID NO: 1163 - protein, 58 aa, ARTIFICIAL SEQUENCE
  Engineered IL-6 binding polypeptide
VDAKYAKEEYDAWAEIHRLPNLTISQMAAFITKLFDDPSQSSELLSEAKKLNDSQAPK

SEQ ID NO: 1164 - protein, 58 aa, ARTIFICIAL SEQUENCE
  Engineered IL-6 binding polypeptide
VDAKYAKEEYHAWTEIHILPNLTINQIAAFITKLFDDPSQSSELLSEAKKLNDSQAPK

SEQ ID NO: 1165 - protein, 58 aa, ARTIFICIAL SEQUENCE
  Engineered IL-6 binding polypeptide
VDAKYAKEERQAWFEIHILPNLTVGQMAAFISKLFDDPSQSSELLSEAKKLNDSQAPK

SEQ ID NO: 1166 - protein, 58 aa, ARTIFICIAL SEQUENCE
  Engineered IL-6 binding polypeptide
VDAKYAKEEAEAWFEIHILPNLTVDQIAAFITKLFDDPSQSSELLSEAKKLNDSQAPK

SEQ ID NO: 1167 - protein, 58 aa, ARTIFICIAL SEQUENCE
  Engineered IL-6 binding polypeptide
VDAKYAKEEKKAWYEIHILPNLTVYQMAAFITKLFDDPSQSSELLSEAKKLNDSQAPK

SEQ ID NO: 1168 - protein, 58 aa, ARTIFICIAL SEQUENCE
  Engineered IL-6 binding polypeptide
VDAKYAKEEKAAWHEIHILPNLTVHQMAAFITKLFDDPSQSSELLSEAKKLNDSQAPK

SEQ ID NO: 1169 - protein, 58 aa, ARTIFICIAL SEQUENCE
  Engineered IL-6 binding polypeptide
VDAKYAKEEAQAWNEIHKLPNLTVEQMAAFISKLFDDPSQSSELLSEAKKLNDSQAPK

SEQ ID NO: 1170 - protein, 58 aa, ARTIFICIAL SEQUENCE
  Engineered IL-6 binding polypeptide
VDAKYAKEEYEAWYEIHILPNLTVHQIAAFITKLFDDPSQSSELLSEAKKLNDSQAPK

SEQ ID NO: 1171 - protein, 58 aa, ARTIFICIAL SEQUENCE
  Engineered IL-6 binding polypeptide
VDAKYAKEEYEAWMEIHLLPNLTVHQMAAFITKLFDDPSQSSELLSEAKKLNDSQAPK

SEQ ID NO: 1172 - protein, 58 aa, ARTIFICIAL SEQUENCE
  Engineered IL-6 binding polypeptide
VDAKYAKEEYDAWFEIHVLPNLTINQMAAFITKLFDDPSQSSELLSEAKKLNDSQAPK

SEQ ID NO: 1173 - protein, 58 aa, ARTIFICIAL SEQUENCE
  Engineered IL-6 binding polypeptide
VDAKYAKEEKRAWNEIHQLPNLTIEQIAAFITKLFDDPSQSSELLSEAKKLNDSQAPK

SEQ ID NO: 1174 - protein, 58 aa, ARTIFICIAL SEQUENCE
  Engineered IL-6 binding polypeptide
VDAKYAKEEARAWWEIHLLPNLTVDQIAAFITKLFDDPSQSSELLSEAKKLNDSQAPK

SEQ ID NO: 1175 - protein, 58 aa, ARTIFICIAL SEQUENCE
  Engineered IL-6 binding polypeptide
VDAKYAKEEKHAWREIHILPNLTVDQIAAFITKLFDDPSQSSELLSEAKKLNDSQAPK

SEQ ID NO: 1176 - protein, 58 aa, ARTIFICIAL SEQUENCE
  Engineered IL-6 binding polypeptide
VDAKYAKEESRAWTEIHLLPNLTVDQMAAFITKLFDDPSQSSELLSEAKKLNDSQAPK

SEQ ID NO: 1177 - protein, 58 aa, ARTIFICIAL SEQUENCE
  Engineered IL-6 binding polypeptide
VDAKYAKEEAEAWKEIHLLPNLTIGQIAAFITKLFDDPSQSSELLSEAKKLNDSQAPK

SEQ ID NO: 1178 - protein, 58 aa, ARTIFICIAL SEQUENCE
  Engineered IL-6 binding polypeptide
VDAKYAKEEADAWKEIHLLPNLTIEQMAAFITKLFDDPSQSSELLSEAKKLNDSQAPK

SEQ ID NO: 1179 - protein, 58 aa, ARTIFICIAL SEQUENCE
  Engineered IL-6 binding polypeptide
VDAKYAKEEYQAWMEIHILPNLTIEQMAAFITKLFDDPSQSSELLSEAKKLNDSQAPK

SEQ ID NO: 1180 - protein, 58 aa, ARTIFICIAL SEQUENCE
  Engineered IL-6 binding polypeptide
VDAKYAKEEAHAWWEIHKLPNLTVNQMAAFITKLFDDPSQSSELLSEAKKLNDSQAPK

SEQ ID NO: 1181 - protein, 58 aa, ARTIFICIAL SEQUENCE
  Engineered IL-6 binding polypeptide
VDAKYAKEEWYAWNEIHKLPNLTVDQMAAFISKLFDDPSQSSELLSEAKKLNDSQAPK

SEQ ID NO: 1182 - protein, 58 aa, ARTIFICIAL SEQUENCE
  Engineered IL-6 binding polypeptide
VDAKYAKEEKKAWNEIHNLPNLTVDQMAAFITKLFDDPSQSSELLSEAKKLNDSQAPK

SEQ ID NO: 1183 - protein, 58 aa, ARTIFICIAL SEQUENCE
  Engineered IL-6 binding polypeptide
VDAKYAKEEAAAWMEIHGLPNLTVDQVAAFISKLFDDPSQSSELLSEAKKLNDSQAPK

SEQ ID NO: 1184 - protein, 58 aa, ARTIFICIAL SEQUENCE
  Engineered IL-6 binding polypeptide
VDAKYAKEEKFAWREIHILPNLTVEQMAAFITKLFDDPSQSSELLSEAKKLNDSQAPK

SEQ ID NO: 1185 - protein, 58 aa, ARTIFICIAL SEQUENCE
  Engineered IL-6 binding polypeptide
VDAKYAKEEYHAWTEIHQLPNLTIDQMAAFISKLFDDPSQSSELLSEAKKLNDSQAPK

SEQ ID NO: 1186 - protein, 58 aa, ARTIFICIAL SEQUENCE
  Engineered IL-6 binding polypeptide
VDAKYAKEEAMAWNEIHRLPNLTVNQMAAFITKLFDDPSQSSELLSEAKKLNDSQAPK

SEQ ID NO: 1187 - protein, 58 aa, ARTIFICIAL SEQUENCE
  Engineered IL-6 binding polypeptide
VDAKYAKEEQKAWREIHILPNLTVNQMAAFISKLFDDPSQSSELLSEAKKLNDSQAPK

SEQ ID NO: 1188 - protein, 58 aa, ARTIFICIAL SEQUENCE
  Engineered IL-6 binding polypeptide
VDAKYAKEEFAAWLEIHKLPNLTIDQMAAFITKLFDDPSQSSELLSEAKKLNDSQAPK

SEQ ID NO: 1189 - protein, 58 aa, ARTIFICIAL SEQUENCE
  Engineered IL-6 binding polypeptide
VDAKYAKEEAYAWAEIHKLPNLTVNQMAAFITKLFDDPSQSSELLSEAKKLNDSQAPK

SEQ ID NO: 1190 - protein, 58 aa, ARTIFICIAL SEQUENCE
  Engineered IL-6 binding polypeptide
VDAKYAKEEKDAWYEIHILPNLTVRQMAAFISKLFDDPSQSSELLSEAKKLNDSQAPK

SEQ ID NO: 1191 - protein, 58 aa, ARTIFICIAL SEQUENCE
  Engineered IL-6 binding polypeptide
VDAKYAKEEKDAWMEIHLLPNLTVSQIAAFITKLFDDPSQSSELLSEAKKLNDSQAPK

SEQ ID NO: 1192 - protein, 58 aa, ARTIFICIAL SEQUENCE
  Engineered IL-6 binding polypeptide
VDAKYAKEEKEAWTEIHKLPNLTINQMAAFISKLFDDPSQSSELLSEAKKLNDSQAPK

SEQ ID NO: 1193 - protein, 58 aa, ARTIFICIAL SEQUENCE
  Engineered IL-6 binding polypeptide
VDAKYAKEEKDAWREIHILPNLTVDQMAAFISKLFDDPSQSSELLSEAKKLNDSQAPK

SEQ ID NO: 1194 - protein, 58 aa, ARTIFICIAL SEQUENCE
  Engineered IL-6 binding polypeptide
VDAKYAKEEYRAWTEIHLLPNLTIEQMAAFISKLFDDPSQSSELLSEAKKLNDSQAPK

SEQ ID NO: 1195 - protein, 58 aa, ARTIFICIAL SEQUENCE
  Engineered IL-6 binding polypeptide
VDAKYAKEEKFAWHEIHILPNLTVHQMAAFITKLFDDPSQSSELLSEAKKLNDSQAPK

SEQ ID NO: 1196 - protein, 58 aa, ARTIFICIAL SEQUENCE
  Engineered IL-6 binding polypeptide
VDAKYAKEEWEAWLEIHALPNLTVEQMAAFITKLFDDPSQSSELLSEAKKLNDSQAPK

SEQ ID NO: 1197 - protein, 58 aa, ARTIFICIAL SEQUENCE
  Engineered IL-6 binding polypeptide
VDAKYAKEEAAAWQEIHLLPNLTVGQIAAFITKLFDDPSQSSELLSEAKKLNDSQAPK

SEQ ID NO: 1198 - protein, 58 aa, ARTIFICIAL SEQUENCE
  Engineered IL-6 binding polypeptide
VDAKYAKEEKVAWKEIHILPNLTVNQIAAFISKLFDDPSQSSELLSEAKKLNDSQAPK

SEQ ID NO: 1199 - protein, 58 aa, ARTIFICIAL SEQUENCE
  Engineered IL-6 binding polypeptide
VDAKYAKEERVAWQEIHLLPNLTIEQMAAFITKLFDDPSQSSELLSEAKKLNDSQAPK

SEQ ID NO: 1200 - protein, 58 aa, ARTIFICIAL SEQUENCE
  Engineered IL-6 binding polypeptide
VDAKYAKEEYEAWLEIHLLPNLTIDQMAAFITKLFDDPSQSSELLSEAKKLNDSQAPK

SEQ ID NO: 1201 - protein, 58 aa, ARTIFICIAL SEQUENCE
  Engineered IL-6 binding polypeptide
VDAKYAKEEAEAWFEIHNLPNLTIDQMAAFITKLFDDPSQSSELLSEAKKLNDSQAPK

SEQ ID NO: 1202 - protein, 58 aa, ARTIFICIAL SEQUENCE
  Engineered IL-6 binding polypeptide
VDAKYAKEEKYAWWEIHKLPNLTVRQMAAFITKLFDDPSQSSELLSEAKKLNDSQAPK

SEQ ID NO: 1203 - protein, 58 aa, ARTIFICIAL SEQUENCE
  Engineered IL-6 binding polypeptide
VDAKYAKEEYDAWHEIHVLPNLTVSQIAAFISKLFDDPSQSSELLSEAKKLNDSQAPK

SEQ ID NO: 1204 - protein, 58 aa, ARTIFICIAL SEQUENCE
  Engineered IL-6 binding polypeptide
VDAKYAKEEAAAWREIHLLPNLTVDQMAAFITKLFDDPSQSSELLSEAKKLNDSQAPK

SEQ ID NO: 1205 - protein, 58 aa, ARTIFICIAL SEQUENCE
  Engineered IL-6 binding polypeptide
VDAKYAKEEKHAWNEIHKLPNLTVKQVAAFISKLFDDPSQSSELLSEAKKLNDSQAPK

SEQ ID NO: 1206 - protein, 58 aa, ARTIFICIAL SEQUENCE
  Engineered IL-6 binding polypeptide
VDAKYAKEEYDAWTEIHLLPNLTIAQIAAFITKLFDDPSQSSELLSEAKKLNDSQAPK

SEQ ID NO: 1207 - protein, 58 aa, ARTIFICIAL SEQUENCE
  Engineered IL-6 binding polypeptide
VDAKYAKEERKAWHEIHILPNLTVDQMAAFITKLFDDPSQSSELLSEAKKLNDSQAPK

SEQ ID NO: 1208 - protein, 58 aa, ARTIFICIAL SEQUENCE
  Engineered IL-6 binding polypeptide
VDAKYAKEEHDAWHEIHLLPNLTVDQIAAFITKLFDDPSQSSELLSEAKKLNDSQAPK

SEQ ID NO: 1209 - protein, 58 aa, ARTIFICIAL SEQUENCE
  Engineered IL-6 binding polypeptide
VDAKYAKEEYAAWNEIHKLPNLTIIQMAAFITKLFDDPSQSSELLSEAKKLNDSQAPK

SEQ ID NO: 1210 - protein, 58 aa, ARTIFICIAL SEQUENCE
  Engineered IL-6 binding polypeptide
VDAKYAKEEYEAWMEIHLLPNLTIEQMAAFISKLFDDPSQSSELLSEAKKLNDSQAPK

SEQ ID NO: 1211 - protein, 58 aa, ARTIFICIAL SEQUENCE
  Engineered IL-6 binding polypeptide
VDAKYAKEEKHAWIEIHALPNLTIDQMAAFISKLFDDPSQSSELLSEAKKLNDSQAPK

SEQ ID NO: 1212 - protein, 58 aa, ARTIFICIAL SEQUENCE
  Engineered IL-6 binding polypeptide
VDAKYAKEEKYAWHEIHILPNLTVDQVAAFITKLFDDPSQSSELLSEAKKLNDSQAPK

SEQ ID NO: 1213 - protein, 58 aa, ARTIFICIAL SEQUENCE
  Engineered IL-6 binding polypeptide
VDAKYAKEEKDAWHEIHILPNLTVDQMAAFITKLFDDPSQSSELLSEAKKLNDSQAPK

SEQ ID NO: 1214 - protein, 58 aa, ARTIFICIAL SEQUENCE
  Engineered IL-6 binding polypeptide
VDAKYAKEEYHAWMEIHILPNLTIEQIAAFITKLFDDPSQSSELLSEAKKLNDSQAPK

SEQ ID NO: 1215 - protein, 58 aa, ARTIFICIAL SEQUENCE
  Engineered IL-6 binding polypeptide
VDAKYAKEEYRAWHEIHILPNLTIQQMAAFITKLFDDPSQSSELLSEAKKLNDSQAPK

SEQ ID NO: 1216 - protein, 58 aa, ARTIFICIAL SEQUENCE
  Engineered IL-6 binding polypeptide
VDAKYAKEEKFAWHEIHILPNLTVQQMAAFITKLFDDPSQSSELLSEAKKLNDSQAPK

SEQ ID NO: 1217 - protein, 58 aa, ARTIFICIAL SEQUENCE
  Engineered IL-6 binding polypeptide
VDAKYAKEEKHAWTEIHLLPNLTVNQMAAFISKLFDDPSQSSELLSEAKKLNDSQAPK

SEQ ID NO: 1218 - protein, 58 aa, ARTIFICIAL SEQUENCE
  Engineered IL-6 binding polypeptide
VDAKYAKEEEFAWREIHILPNLTISQIAAFITKLFDDPSQSSELLSEAKKLNDSQAPK

SEQ ID NO: 1219 - protein, 58 aa, ARTIFICIAL SEQUENCE
  Engineered IL-6 binding polypeptide
VDAKYAKEEKMAWKEIHVLPNLTVDQMAAFITKLFDDPSQSSELLSEAKKLNDSQAPK

SEQ ID NO: 1220 - protein, 58 aa, ARTIFICIAL SEQUENCE
  Engineered IL-6 binding polypeptide
VDAKYAKEEYAAWHEIHVLPNLTIGQMAAFITKLFDDPSQSSELLSEAKKLNDSQAPK

SEQ ID NO: 1221 - protein, 58 aa, ARTIFICIAL SEQUENCE
  Engineered IL-6 binding polypeptide
VDAKYAKEEQYAWQEIHKLPNLTVEQMAAFITKLFDDPSQSSELLSEAKKLNDSQAPK

SEQ ID NO: 1222 - protein, 58 aa, ARTIFICIAL SEQUENCE
  Engineered IL-6 binding polypeptide
VDAKYAKEEWEAWNEIHSLPNLTIDQIAAFITKLFDDPSQSSELLSEAKKLNDSQAPK

SEQ ID NO: 1223 - protein, 58 aa, ARTIFICIAL SEQUENCE
  Engineered IL-6 binding polypeptide
VDAKYAKEEKMAWKEIHLLPNLTVEQMAAFITKLFDDPSQSSELLSEAKKLNDSQAPK

SEQ ID NO: 1224 - protein, 58 aa, ARTIFICIAL SEQUENCE
  Engineered IL-6 binding polypeptide
VDAKYAKEEAHAWREIHNLPNLTIEQMAAFISKLFDDPSQSSELLSEAKKLNDSQAPK

SEQ ID NO: 1225 - protein, 58 aa, ARTIFICIAL SEQUENCE
  Engineered IL-6 binding polypeptide
VDAKYAKEERRAWTEIHILPNLTVDQIAAFISKLFDDPSQSSELLSEAKKLNDSQAPK

SEQ ID NO: 1226 - protein, 58 aa, ARTIFICIAL SEQUENCE
  Engineered IL-6 binding polypeptide
VDAKYAKEEYEAWMEIHLLPNLTINQIAAFITKLFDDPSQSSELLSEAKKLNDSQAPK

SEQ ID NO: 1227 - protein, 58 aa, ARTIFICIAL SEQUENCE
  Engineered IL-6 binding polypeptide
VDAKYAKEEKHAWMEIHALPNLTIDQMAAFITKLFDDPSQSSELLSEAKKLNDSQAPK

SEQ ID NO: 1228 - protein, 58 aa, ARTIFICIAL SEQUENCE
  Engineered IL-6 binding polypeptide
VDAKYAKEEHQAWHEIHILPNLTIQQMAAFITKLFDDPSQSSELLSEAKKLNDSQAPK

SEQ ID NO: 1229 - protein, 58 aa, ARTIFICIAL SEQUENCE
  Engineered IL-6 binding polypeptide
VDAKYAKEEYYAWREIHLLPNLTVDQMAAFITKLFDDPSQSSELLSEAKKLNDSQAPK

SEQ ID NO: 1230 - protein, 58 aa, ARTIFICIAL SEQUENCE
  Engineered IL-6 binding polypeptide
VDAKYAKEEQEAWMEIHKLPNLTIDQVAAFITKLFDDPSQSSELLSEAKKLNDSQAPK

SEQ ID NO: 1231 - protein, 58 aa, ARTIFICIAL SEQUENCE
  Engineered IL-6 binding polypeptide
VDAKYAKEEAHAWTEIHSLPNLTVDQMAAFITKLFDDPSQSSELLSEAKKLNDSQAPK

SEQ ID NO: 1232 - protein, 58 aa, ARTIFICIAL SEQUENCE
  Engineered IL-6 binding polypeptide
VDAKYAKEEKLAWKEIHLLPNLTISQMAAFITKLFDDPSQSSELLSEAKKLNDSQAPK

SEQ ID NO: 1233 - protein, 58 aa, ARTIFICIAL SEQUENCE
  Engineered IL-6 binding polypeptide
VDAKYAKEEYDAWTEIHKLPNLTVDQMAAFISKLFDDPSQSSELLSEAKKLNDSQAPK

SEQ ID NO: 1234 - protein, 58 aa, ARTIFICIAL SEQUENCE
  Engineered IL-6 binding polypeptide
VDAKYAKEEARAWMEIHNLPNLTVDQMAAFITKLFDDPSQSSELLSEAKKLNDSQAPK

SEQ ID NO: 1235 - protein, 58 aa, ARTIFICIAL SEQUENCE
  Engineered IL-6 binding polypeptide
VDAKYAKEEYRAWTEIHLLPNLTVHQMAAFITKLFDDPSQSSELLSEAKKLNDSQAPK

SEQ ID NO: 1236 - protein, 58 aa, ARTIFICIAL SEQUENCE
  Engineered IL-6 binding polypeptide
VDAKYAKEEYHAWYEIHILPNLTVEQIAAFITKLFDDPSQSSELLSEAKKLNDSQAPK

SEQ ID NO: 1237 - protein, 58 aa, ARTIFICIAL SEQUENCE
  Engineered IL-6 binding polypeptide
VDAKYAKEESDAWKEIHLLPNLTIEQMAAFISKLFDDPSQSSELLSEAKKLNDSQAPK

SEQ ID NO: 1238 - protein, 58 aa, ARTIFICIAL SEQUENCE
  Engineered IL-6 binding polypeptide
VDAKYAKEEAYAWREIHILPNLTVDQMAAFISKLFDDPSQSSELLSEAKKLNDSQAPK

SEQ ID NO: 1239 - protein, 58 aa, ARTIFICIAL SEQUENCE
  Engineered IL-6 binding polypeptide
VDAKYAKEEAAAWNEIHRLPNLTIDQMAAFISKLFDDPSQSSELLSEAKKLNDSQAPK

SEQ ID NO: 1240 - protein, 58 aa, ARTIFICIAL SEQUENCE
  Engineered IL-6 binding polypeptide
VDAKYAKEEYHAWWEIHKLPNLTVNQMAAFITKLFDDPSQSSELLSEAKKLNDSQAPK

SEQ ID NO: 1241 - protein, 58 aa, ARTIFICIAL SEQUENCE
  Engineered IL-6 binding polypeptide
VDAKYAKEEKAAWYEIHKLPNLTIDQMAAFITKLFDDPSQSSELLSEAKKLNDSQAPK

SEQ ID NO: 1242 - protein, 58 aa, ARTIFICIAL SEQUENCE
  Engineered IL-6 binding polypeptide
VDAKYAKEEKEAWTEIHLLPNLTVDQIAAFITKLFDDPSQSSELLSEAKKLNDSQAPK

SEQ ID NO: 1243 - protein, 58 aa, ARTIFICIAL SEQUENCE
  Engineered IL-6 binding polypeptide
VDAKYAKEEKRAWYEIHGLPNLTISQMAAFISKLFDDPSQSSELLSEAKKLNDSQAPK

SEQ ID NO: 1244 - protein, 58 aa, ARTIFICIAL SEQUENCE
  Engineered IL-6 binding polypeptide
VDAKYAKEEARAWYEIHILPNLTVHQMAAFITKLFDDPSQSSELLSEAKKLNDSQAPK

SEQ ID NO: 1245 - protein, 58 aa, ARTIFICIAL SEQUENCE
  Engineered IL-6 binding polypeptide
VDAKYAKEEKTAWVEIHKLPNLTINQMAAFITKLFDDPSQSSELLSEAKKLNDSQAPK

SEQ ID NO: 1246 - protein, 58 aa, ARTIFICIAL SEQUENCE
  Engineered IL-6 binding polypeptide
VDAKYAKEERDAWFEIHILPNLTVEQMAAFITKLFDDPSQSSELLSEAKKLNDSQAPK

SEQ ID NO: 1247 - protein, 58 aa, ARTIFICIAL SEQUENCE
  Engineered IL-6 binding polypeptide
VDAKYAKEEAMAWKEIHGLPNLTIEQMAAFISKLFDDPSQSSELLSEAKKLNDSQAPK

SEQ ID NO: 1248 - protein, 58 aa, ARTIFICIAL SEQUENCE
  Engineered IL-6 binding polypeptide
VDAKYAKEEQYAWREIHILPNLTVHQVAAFISKLFDDPSQSSELLSEAKKLNDSQAPK

SEQ ID NO: 1249 - protein, 58 aa, ARTIFICIAL SEQUENCE
  Engineered IL-6 binding polypeptide
VDAKYAKEEWEAWIEIHNLPNLTVGQMAAFITKLFDDPSQSSELLSEAKKLNDSQAPK

SEQ ID NO: 1250 - protein, 58 aa, ARTIFICIAL SEQUENCE
  Engineered IL-6 binding polypeptide
VDAKYAKEEYAAWTEIHTLPNLTVDQVAAFISKLFDDPSQSSELLSEAKKLNDSQAPK

SEQ ID NO: 1251 - protein, 58 aa, ARTIFICIAL SEQUENCE
  Engineered IL-6 binding polypeptide
VDAKYAKEEEDAWHEIHLLPNLTIEQMAAFITKLFDDPSQSSELLSEAKKLNDSQAPK

SEQ ID NO: 1252 - protein, 58 aa, ARTIFICIAL SEQUENCE
  Engineered IL-6 binding polypeptide
VDAKYAKEERNAWYEIHALPNLTVEQMAAFITKLFDDPSQSSELLSEAKKLNDSQAPK

SEQ ID NO: 1253 - protein, 58 aa, ARTIFICIAL SEQUENCE
  Engineered IL-6 binding polypeptide
VDAKYAKEEKRAWYEIHILPNLTVEQIAAFITKLFDDPSQSSELLSEAKKLNDSQAPK

SEQ ID NO: 1254 - protein, 58 aa, ARTIFICIAL SEQUENCE
  Engineered IL-6 binding polypeptide
VDAKYAKEEYQAWIEIHILPNLTISQMAAFITKLFDDPSQSSELLSEAKKLNDSQAPK

SEQ ID NO: 1255 - protein, 58 aa, ARTIFICIAL SEQUENCE
  Engineered IL-6 binding polypeptide
VDAKYAKEEKRAWYEIHLLPNLTIGQMAAFITKLFDDPSQSSELLSEAKKLNDSQAPK

SEQ ID NO: 1256 - protein, 58 aa, ARTIFICIAL SEQUENCE
  Engineered IL-6 binding polypeptide
VDAKYAKEEYLAWLEIHNLPNLTVDQMAAFITKLFDDPSQSSELLSEAKKLNDSQAPK

SEQ ID NO: 1257 - protein, 58 aa, ARTIFICIAL SEQUENCE
  Engineered IL-6 binding polypeptide
VDAKYAKEEYFAWYEIHNLPNLTVDQMAAFITKLFDDPSQSSELLSEAKKLNDSQAPK

SEQ ID NO: 1258 - protein, 58 aa, ARTIFICIAL SEQUENCE
  Engineered IL-6 binding polypeptide
VDAKYAKEEAFAWWEIHKLPNLTVEQMAAFITKLFDDPSQSSELLSEAKKLNDSQAPK

SEQ ID NO: 1259 - protein, 58 aa, ARTIFICIAL SEQUENCE
  Engineered IL-6 binding polypeptide
VDAKYAKEESIAWQEIHKLPNLTIEQMAAFITKLFDDPSQSSELLSEAKKLNDSQAPK

SEQ ID NO: 1260 - protein, 58 aa, ARTIFICIAL SEQUENCE
  Engineered IL-6 binding polypeptide
VDAKYAKEEWDAWNEIHLLPNLTINQMAAFITKLFDDPSQSSELLSEAKKLNDSQAPK

SEQ ID NO: 1261 - protein, 58 aa, ARTIFICIAL SEQUENCE
  Engineered IL-6 binding polypeptide
VDAKYAKEEAYAWNEIHRLPNLTVEQMAAFITKLFDDPSQSSELLSEAKKLNDSQAPK

SEQ ID NO: 1262 - protein, 58 aa, ARTIFICIAL SEQUENCE
  Engineered IL-6 binding polypeptide
VDAKYAKEEAEAWFEIHKLPNLTVGQMAAFITKLFDDPSQSSELLSEAKKLNDSQAPK

SEQ ID NO: 1263 - protein, 58 aa, ARTIFICIAL SEQUENCE
  Engineered IL-6 binding polypeptide
VDAKYAKEEREAWHEIHILPNLTVEQVAAFITKLFDDPSQSSELLSEAKKLNDSQAPK

SEQ ID NO: 1264 - protein, 58 aa, ARTIFICIAL SEQUENCE
  Engineered IL-6 binding polypeptide
VDAKYAKEEHDAWMEIHLLPNLTIEQMAAFITKLFDDPSQSSELLSEAKKLNDSQAPK

SEQ ID NO: 1265 - protein, 58 aa, ARTIFICIAL SEQUENCE
  Engineered IL-6 binding polypeptide
VDAKYAKEEYSAWIEIHLLPNLTVSQMAAFITKLFDDPSQSSELLSEAKKLNDSQAPK

SEQ ID NO: 1266 - protein, 58 aa, ARTIFICIAL SEQUENCE
  Engineered IL-6 binding polypeptide
VDAKYAKEEYDAWYEIHTLPNLTVDQVAAFITKLFDDPSQSSELLSEAKKLNDSQAPK

SEQ ID NO: 1267 - protein, 58 aa, ARTIFICIAL SEQUENCE
  Engineered IL-6 binding polypeptide
VDAKYAKEEKMAWTEIHNLPNLTIDQMAAFITKLFDDPSQSSELLSEAKKLNDSQAPK

SEQ ID NO: 1268 - protein, 58 aa, ARTIFICIAL SEQUENCE
  Engineered IL-6 binding polypeptide
VDAKYAKEEYAAWFEIHSLPNLTVEQMAAFITKLFDDPSQSSELLSEAKKLNDSQAPK

SEQ ID NO: 1269 - protein, 58 aa, ARTIFICIAL SEQUENCE
  Engineered IL-6 binding polypeptide
VDAKYAKEERRAWDEIHRLPNLTIEQMAAFITKLFDDPSQSSELLSEAKKLNDSQAPK

SEQ ID NO: 1270 - protein, 58 aa, ARTIFICIAL SEQUENCE
  Engineered IL-6 binding polypeptide
VDAKYAKEEYDAWLEIHLLPNLTIEQMAAFITKLFDDPSQSSELLSEAKKLNDSQAPK

SEQ ID NO: 1271 - protein, 58 aa, ARTIFICIAL SEQUENCE
  Engineered IL-6 binding polypeptide
VDAKYAKEEYDAWNEIHTLPNLTIDQMAAFITKLFDDPSQSSELLSEAKKLNDSQAPK

SEQ ID NO: 1272 - protein, 58 aa, ARTIFICIAL SEQUENCE
  Engineered IL-6 binding polypeptide
VDAKYAKEERVAWNEIHKLPNLTIDQMAAFITKLFDDPSQSSELLSEAKKLNDSQAPK

SEQ ID NO: 1273 - protein, 58 aa, ARTIFICIAL SEQUENCE
  Engineered IL-6 binding polypeptide
VDAKYAKEEAHAWTEIHKLPNLTVDQMAAFITKLFDDPSQSSELLSEAKKLNDSQAPK

SEQ ID NO: 1274 - protein, 58 aa, ARTIFICIAL SEQUENCE
  Engineered IL-6 binding polypeptide
VDAKYAKEEYRAWMEIHLLPNLTIDQMAAFITKLFDDPSQSSELLSEAKKLNDSQAPK

SEQ ID NO: 1275 - protein, 58 aa, ARTIFICIAL SEQUENCE
  Engineered IL-6 binding polypeptide
VDAKYAKEESAAWTEIHLLPNLTIEQMAAFITKLFDDPSQSSELLSEAKKLNDSQAPK

SEQ ID NO: 1276 - protein, 58 aa, ARTIFICIAL SEQUENCE
  Engineered IL-6 binding polypeptide
VDAKYAKEEYFAWTEIHVLPNLTVKQIAAFITKLFDDPSQSSELLSEAKKLNDSQAPK

SEQ ID NO: 1277 - protein, 58 aa, ARTIFICIAL SEQUENCE
  Engineered IL-6 binding polypeptide
VDAKYAKEEFHAWSEIHLLPNLTVSQMAAFISKLFDDPSQSSELLSEAKKLNDSQAPK

SEQ ID NO: 1278 - protein, 58 aa, ARTIFICIAL SEQUENCE
  Engineered IL-6 binding polypeptide
VDAKYAKEEYDAWTEIHALPNLTVDQVAAFITKLFDDPSQSSELLSEAKKLNDSQAPK

SEQ ID NO: 1279 - protein, 58 aa, ARTIFICIAL SEQUENCE
  Engineered IL-6 binding polypeptide
VDAKYAKEEKAAWFEIHNLPNLTISQMAAFITKLFDDPSQSSELLSEAKKLNDSQAPK

SEQ ID NO: 1280 - protein, 58 aa, ARTIFICIAL SEQUENCE
  Engineered IL-6 binding polypeptide
VDAKYAKEEYQAWIEIHALPNLTIEQMAAFITKLFDDPSQSSELLSEAKKLNDSQAPK

SEQ ID NO: 1281 - protein, 58 aa, ARTIFICIAL SEQUENCE
  Engineered IL-6 binding polypeptide
VDAKYAKEEYDAWVEIHKLPNLTINQMAAFITKLFDDPSQSSELLSEAKKLNDSQAPK

SEQ ID NO: 1282 - protein, 58 aa, ARTIFICIAL SEQUENCE
  Engineered IL-6 binding polypeptide
VDAKYAKEEQSAWMEIHILPNLTVSQIAAFISKLFDDPSQSSELLSEAKKLNDSQAPK

SEQ ID NO: 1283 - protein, 58 aa, ARTIFICIAL SEQUENCE
  Engineered IL-6 binding polypeptide
VDAKYAKEERAAWNEIHSLPNLTVEQMAAFITKLFDDPSQSSELLSEAKKLNDSQAPK

SEQ ID NO: 1284 - protein, 58 aa, ARTIFICIAL SEQUENCE
  Engineered IL-6 binding polypeptide
VDAKYAKEEHEAWNEIHKLPNLTIDQMAAFITKLFDDPSQSSELLSEAKKLNDSQAPK

SEQ ID NO: 1285 - protein, 58 aa, ARTIFICIAL SEQUENCE
  Engineered IL-6 binding polypeptide
VDAKYAKEERFAWWEIHRLPNLTVRQVAAFISKLFDDPSQSSELLSEAKKLNDSQAPK

SEQ ID NO: 1286 - protein, 58 aa, ARTIFICIAL SEQUENCE
  Engineered IL-6 binding polypeptide
VDAKYAKEEFEAWYEIHILPNLTVEQMAAFITKLFDDPSQSSELLSEAKKLNDSQAPK

SEQ ID NO: 1287 - protein, 58 aa, ARTIFICIAL SEQUENCE
  Engineered IL-6 binding polypeptide
VDAKYAKEEKDAWNEIHRLPNLTVDQVAAFITKLFDDPSQSSELLSEAKKLNDSQAPK

SEQ ID NO: 1288 - protein, 58 aa, ARTIFICIAL SEQUENCE
  Engineered IL-6 binding polypeptide
VDAKYAKEEARAWYEIHVLPNLTVHQIAAFITKLFDDPSQSSELLSEAKKLNDSQAPK

SEQ ID NO: 1289 - protein, 58 aa, ARTIFICIAL SEQUENCE
  Engineered IL-6 binding polypeptide
VDAKYAKEERRAWNEIHKLPNLTVEQMAAFITKLFDDPSQSSELLSEAKKLNDSQAPK

SEQ ID NO: 1290 - protein, 58 aa, ARTIFICIAL SEQUENCE
  Engineered IL-6 binding polypeptide
VDAKYAKEEYMAWDEIHRLPNLTVEQMAAFITKLFDDPSQSSELLSEAKKLNDSQAPK

SEQ ID NO: 1291 - protein, 58 aa, ARTIFICIAL SEQUENCE
  Engineered IL-6 binding polypeptide
VDAKYAKEERNAWFEIHALPNLTIDQMAAFITKLFDDPSQSSELLSEAKKLNDSQAPK

SEQ ID NO: 1292 - protein, 58 aa, ARTIFICIAL SEQUENCE
  Engineered IL-6 binding polypeptide
VDAKYAKEEAEAWQEIHLLPNLTVGQMAAFISKLFDDPSQSSELLSEAKKLNDSQAPK

SEQ ID NO: 1293 - protein, 58 aa, ARTIFICIAL SEQUENCE
  Engineered IL-6 binding polypeptide
VDAKYAKEEKNAWYEIHLLPNLTIQQMAAFISKLFDDPSQSSELLSEAKKLNDSQAPK

SEQ ID NO: 1294 - protein, 58 aa, ARTIFICIAL SEQUENCE
  Engineered IL-6 binding polypeptide
VDAKYAKEEAIAWHEIHLLPNLTITQMAAFITKLFDDPSQSSELLSEAKKLNDSQAPK

SEQ ID NO: 1295 - protein, 58 aa, ARTIFICIAL SEQUENCE
  Engineered IL-6 binding polypeptide
VDAKYAKEEKDAWEEIHRLPNLTVTQMAAFISKLFDDPSQSSELLSEAKKLNDSQAPK

SEQ ID NO: 1296 - protein, 58 aa, ARTIFICIAL SEQUENCE
  Engineered IL-6 binding polypeptide
VDAKYAKEEYDAWFEIHLLPNLTVQQIAAFITKLFDDPSQSSELLSEAKKLNDSQAPK

SEQ ID NO: 1297 - protein, 58 aa, ARTIFICIAL SEQUENCE
  Engineered IL-6 binding polypeptide
VDAKYAKEEAAAWMEIHLLPNLTVEQMAAFITKLFDDPSQSSELLSEAKKLNDSQAPK

SEQ ID NO: 1298 - protein, 58 aa, ARTIFICIAL SEQUENCE
  Engineered IL-6 binding polypeptide
VDAKYAKEERKAWNEIHQLPNLTIQQVAAFITKLFDDPSQSSELLSEAKKLNDSQAPK

SEQ ID NO: 1299 - protein, 58 aa, ARTIFICIAL SEQUENCE
  Engineered IL-6 binding polypeptide
VDAKYAKEEYAAWWEIHALPNLTVEQVAAFITKLFDDPSQSSELLSEAKKLNDSQAPK

SEQ ID NO: 1300 - protein, 58 aa, ARTIFICIAL SEQUENCE
  Engineered IL-6 binding polypeptide
VDAKYAKEEKEAWMEIHILPNLTIDQMAAFITKLFDDPSQSSELLSEAKKLNDSQAPK

SEQ ID NO: 1301 - protein, 58 aa, ARTIFICIAL SEQUENCE
  Engineered IL-6 binding polypeptide
VDAKYAKEEKIAWKEIHLLPNLTISQMAAFITKLFDDPSQSSELLSEAKKLNDSQAPK

SEQ ID NO: 1302 - protein, 58 aa, ARTIFICIAL SEQUENCE
  Engineered IL-6 binding polypeptide
VDAKYAKEEHAAWMEIHLLPNLTVDQMAAFITKLFDDPSQSSELLSEAKKLNDSQAPK

SEQ ID NO: 1303 - protein, 58 aa, ARTIFICIAL SEQUENCE
  Engineered IL-6 binding polypeptide
VDAKYAKEEKDAWYEIHILPNLTVDQMAAFITKLFDDPSQSSELLSEAKKLNDSQAPK

SEQ ID NO: 1304 - protein, 58 aa, ARTIFICIAL SEQUENCE
  Engineered IL-6 binding polypeptide
VDAKYAKEERAAWNEIHKLPNLTIEQMAAFITKLFDDPSQSSELLSEAKKLNDSQAPK

SEQ ID NO: 1305 - protein, 58 aa, ARTIFICIAL SEQUENCE
  Engineered IL-6 binding polypeptide
VDAKYAKEEAAAWFEIHILPNLTVGQIAAFITKLFDDPSQSSELLSEAKKLNDSQAPK

SEQ ID NO: 1306 - protein, 58 aa, ARTIFICIAL SEQUENCE
  Engineered IL-6 binding polypeptide
VDAKYAKEEKFAWTEIHNLPNLTVDQMAAFITKLFDDPSQSSELLSEAKKLNDSQAPK

SEQ ID NO: 1307 - protein, 58 aa, ARTIFICIAL SEQUENCE
  Engineered IL-6 binding polypeptide
VDAKYAKEEWLAWNEIHLLPNLTVDQMAAFITKLFDDPSQSSELLSEAKKLNDSQAPK

SEQ ID NO: 1308 - protein, 58 aa, ARTIFICIAL SEQUENCE
  Engineered IL-6 binding polypeptide
VDAKYAKEEQRAWREIHILPNLTIDQMAAFITKLFDDPSQSSELLSEAKKLNDSQAPK

SEQ ID NO: 1309 - protein, 58 aa, ARTIFICIAL SEQUENCE
  Engineered IL-6 binding polypeptide
VDAKYAKEEFQAWREIHLLPNLTIEQMAAFITKLFDDPSQSSELLSEAKKLNDSQAPK

SEQ ID NO: 1310 - protein, 58 aa, ARTIFICIAL SEQUENCE
  Engineered IL-6 binding polypeptide
VDAKYAKEERMAWHEIHILPNLTVSQVAAFITKLFDDPSQSSELLSEAKKLNDSQAPK

SEQ ID NO: 1311 - protein, 58 aa, ARTIFICIAL SEQUENCE
  Engineered IL-6 binding polypeptide
VDAKYAKEEKKAWYEIHILPNLTVNQIAAFITKLFDDPSQSSELLSEAKKLNDSQAPK

SEQ ID NO: 1312 - protein, 58 aa, ARTIFICIAL SEQUENCE
  Engineered IL-6 binding polypeptide
VDAKYAKEEYYAWNEIHKLPNLTVIQVAAFITKLFDDPSQSSELLSEAKKLNDSQAPK

SEQ ID NO: 1313 - protein, 58 aa, ARTIFICIAL SEQUENCE
  Engineered IL-6 binding polypeptide
VDAKYAKEEADAWREIHLLPNLTLEQMAAFITKLFDDPSQSSELLSEAKKLNDSQAPK

SEQ ID NO: 1314 - protein, 58 aa, ARTIFICIAL SEQUENCE
  Engineered IL-6 binding polypeptide
VDAKYAKEEYEAWNEIHRLPNLTIDQMAAFISKLFDDPSQSSELLSEAKKLNDSQAPK

SEQ ID NO: 1315 - protein, 58 aa, ARTIFICIAL SEQUENCE
  Engineered IL-6 binding polypeptide
VDAKYAKEEKKAWWEIHALPNLTVNQVAAFISKLFDDPSQSSELLSEAKKLNDSQAPK

SEQ ID NO: 1316 - protein, 58 aa, ARTIFICIAL SEQUENCE
  Engineered IL-6 binding polypeptide
VDAKYAKEEKTAWREIHLLPNLTIEQMAAFITKLFDDPSQSSELLSEAKKLNDSQAPK

SEQ ID NO: 1317 - protein, 58 aa, ARTIFICIAL SEQUENCE
  Engineered IL-6 binding polypeptide
VDAKYAKEEKDAWYEIHLLPNLTVDQIAAFITKLFDDPSQSSELLSEAKKLNDSQAPK

SEQ ID NO: 1318 - protein, 58 aa, ARTIFICIAL SEQUENCE
  Engineered IL-6 binding polypeptide
VDAKYAKEEYTAWYEIHILPNLTIKQMAAFISKLFDDPSQSSELLSEAKKLNDSQAPK

SEQ ID NO: 1319 - protein, 58 aa, ARTIFICIAL SEQUENCE
  Engineered IL-6 binding polypeptide
VDAKYAKEEYHAWYEIHLLPNLTIEQIAAFITKLFDDPSQSSELLSEAKKLNDSQAPK

SEQ ID NO: 1320 - protein, 58 aa, ARTIFICIAL SEQUENCE
  Engineered IL-6 binding polypeptide
VDAKYAKEEAHAWREIHLLPNLTVLQMAAFITKLFDDPSQSSELLSEAKKLNDSQAPK

SEQ ID NO: 1321 - protein, 58 aa, ARTIFICIAL SEQUENCE
  Engineered IL-6 binding polypeptide
VDAKYAKEEYEAWNEIHKLPNLTIDQMAAFITKLFDDPSQSSELLSEAKKLNDSQAPK

SEQ ID NO: 1322 - protein, 58 aa, ARTIFICIAL SEQUENCE
  Engineered IL-6 binding polypeptide
VDAKYAKEERAAWNEIHALPNLTIDQMAAFITKLFDDPSQSSELLSEAKKLNDSQAPK

SEQ ID NO: 1323 - protein, 58 aa, ARTIFICIAL SEQUENCE
  Engineered IL-6 binding polypeptide
VDAKYAKEEFDAWVEIHLLPNLTIDQMAAFITKLFDDPSQSSELLSEAKKLNDSQAPK

SEQ ID NO: 1324 - protein, 58 aa, ARTIFICIAL SEQUENCE
  Engineered IL-6 binding polypeptide
VDAKYAKEEKAAWKEIHILPNLTVDQMAAFITKLFDDPSQSSELLSEAKKLNDSQAPK

SEQ ID NO: 1325 - protein, 58 aa, ARTIFICIAL SEQUENCE
  Engineered IL-6 binding polypeptide
VDAKYAKEEWDAWLEIHALPNLTVDQVAAFISKLFDDPSQSSELLSEAKKLNDSQAPK

SEQ ID NO: 1326 - protein, 58 aa, ARTIFICIAL SEQUENCE
  Engineered IL-6 binding polypeptide
VDAKYAKEEYNAWYEIHSLPNLTVEQMAAFITKLFDDPSQSSELLSEAKKLNDSQAPK

SEQ ID NO: 1327 - protein, 58 aa, ARTIFICIAL SEQUENCE
  Engineered IL-6 binding polypeptide
VDAKYAKEEWNAWNEIHKLPNLTVEQMAAFITKLFDDPSQSSELLSEAKKLNDSQAPK

SEQ ID NO: 1328 - protein, 58 aa, ARTIFICIAL SEQUENCE
  Engineered IL-6 binding polypeptide
VDAKYAKEEKEAWFEIHILPNLTVEQIAAFISKLFDDPSQSSELLSEAKKLNDSQAPK

SEQ ID NO: 1329 - protein, 58 aa, ARTIFICIAL SEQUENCE
  Engineered IL-6 binding polypeptide
VDAKYAKEEATAWWEIHKLPNLTVQQVAAFISKLFDDPSQSSELLSEAKKLNDSQAPK

SEQ ID NO: 1330 - protein, 58 aa, ARTIFICIAL SEQUENCE
  Engineered IL-6 binding polypeptide
VDAKYAKEEYEAWYEIHILPNLTVGQIAAFITKLFDDPSQSSELLSEAKKLNDSQAPK

SEQ ID NO: 1331 - protein, 58 aa, ARTIFICIAL SEQUENCE
  Engineered IL-6 binding polypeptide
VDAKYAKEEANAWKEIHLLPNLTVGQVAAFITKLFDDPSQSSELLSEAKKLNDSQAPK

SEQ ID NO: 1332 - protein, 58 aa, ARTIFICIAL SEQUENCE
  Engineered IL-6 binding polypeptide
VDAKYAKEEKRAWHEIHVLPNLTVEQIAAFITKLFDDPSQSSELLSEAKKLNDSQAPK

SEQ ID NO: 1333 - protein, 58 aa, ARTIFICIAL SEQUENCE
  Engineered IL-6 binding polypeptide
VDAKYAKEEYDAWVEIHLLPNLTIDQIAAFITKLFDDPSQSSELLSEAKKLNDSQAPK

SEQ ID NO: 1334 - protein, 58 aa, ARTIFICIAL SEQUENCE
  Engineered IL-6 binding polypeptide
VDAKYAKEEAEAWFEIHILPNLTINQIAAFITKLFDDPSQSSELLSEAKKLNDSQAPK

SEQ ID NO: 1335 - protein, 58 aa, ARTIFICIAL SEQUENCE
  Engineered IL-6 binding polypeptide
VDAKYAKEEWHAWNEIHKLPNLTIDQMAAFITKLFDDPSQSSELLSEAKKLNDSQAPK

SEQ ID NO: 1336 - protein, 58 aa, ARTIFICIAL SEQUENCE
  Engineered IL-6 binding polypeptide
VDAKYAKEEYEAWFEIHILPNLTVDQIAAFITKLFDDPSQSSELLSEAKKLNDSQAPK

SEQ ID NO: 1337 - protein, 58 aa, ARTIFICIAL SEQUENCE
  Engineered IL-6 binding polypeptide
VDAKYAKEEYEAWREIHLLPNLTVSQMAAFITKLFDDPSQSSELLSEAKKLNDSQAPK

SEQ ID NO: 1338 - protein, 58 aa, ARTIFICIAL SEQUENCE
  Engineered IL-6 binding polypeptide
VDAKYAKEERAAWFEIHILPNLTISQMAAFITKLFDDPSQSSELLSEAKKLNDSQAPK

SEQ ID NO: 1339 - protein, 58 aa, ARTIFICIAL SEQUENCE
  Engineered IL-6 binding polypeptide
VDAKYAKEEAQAWKEIHLLPNLTIEQMAAFISKLFDDPSQSSELLSEAKKLNDSQAPK

SEQ ID NO: 1340 - protein, 58 aa, ARTIFICIAL SEQUENCE
  Engineered IL-6 binding polypeptide
VDAKYAKEEKAAWFEIHILPNLTIHQMAAFITKLFDDPSQSSELLSEAKKLNDSQAPK

SEQ ID NO: 1341 - protein, 58 aa, ARTIFICIAL SEQUENCE
  Engineered IL-6 binding polypeptide
VDAKYAKEEYEAWIEIHNLPNLTIEQMAAFITKLFDDPSQSSELLSEAKKLNDSQAPK

SEQ ID NO: 1342 - protein, 58 aa, ARTIFICIAL SEQUENCE
  Engineered IL-6 binding polypeptide
VDAKYAKEEKYAWVEIHKLPNLTVEQVAAFITKLFDDPSQSSELLSEAKKLNDSQAPK

SEQ ID NO: 1343 - protein, 58 aa, ARTIFICIAL SEQUENCE
  Engineered IL-6 binding polypeptide
VDAKYAKEEYHAWWEIHLLPNLTVEQMAAFITKLFDDPSQSSELLSEAKKLNDSQAPK

SEQ ID NO: 1344 - protein, 58 aa, ARTIFICIAL SEQUENCE
  Engineered IL-6 binding polypeptide
VDAKYAKEEKAAWNEIHLLPNLTIDQIAAFITKLFDDPSQSSELLSEAKKLNDSQAPK

SEQ ID NO: 1345 - protein, 58 aa, ARTIFICIAL SEQUENCE
  Engineered IL-6 binding polypeptide
VDAKYAKEEYRAWIEIHLLPNLTVEQMAAFISKLFDDPSQSSELLSEAKKLNDSQAPK

SEQ ID NO: 1346 - protein, 58 aa, ARTIFICIAL SEQUENCE
  Engineered IL-6 binding polypeptide
VDAKYAKEEHDAWFEIHLLPNLTIEQMAAFITKLFDDPSQSSELLSEAKKLNDSQAPK

SEQ ID NO: 1347 - protein, 58 aa, ARTIFICIAL SEQUENCE
  Engineered IL-6 binding polypeptide
VDAKYAKEERNAWMEIHLLPNLTVEQMAAFITKLFDDPSQSSELLSEAKKLNDSQAPK

SEQ ID NO: 1348 - protein, 58 aa, ARTIFICIAL SEQUENCE
  Engineered IL-6 binding polypeptide
VDAKYAKEEKHAWYEIHVLPNLTVDQMAAFITKLFDDPSQSSELLSEAKKLNDSQAPK

SEQ ID NO: 1349 - protein, 58 aa, ARTIFICIAL SEQUENCE
  Engineered IL-6 binding polypeptide
VDAKYAKEEHDAWYEIHILPNLTIHQMAAFITKLFDDPSQSSELLSEAKKLNDSQAPK

SEQ ID NO: 1350 - protein, 58 aa, ARTIFICIAL SEQUENCE
  Engineered IL-6 binding polypeptide
VDAKYAKEEKEAWYEIHLLPNLTVNQMAAFITKLFDDPSQSSELLSEAKKLNDSQAPK

SEQ ID NO: 1351 - protein, 58 aa, ARTIFICIAL SEQUENCE
  Engineered IL-6 binding polypeptide
VDAKYAKEEAAAWMEIHLLPNLTVGQMAAFITKLFDDPSQSSELLSEAKKLNDSQAPK

SEQ ID NO: 1352 - protein, 58 aa, ARTIFICIAL SEQUENCE
  Engineered IL-6 binding polypeptide
VDAKYAKEEAYAWREIHLLPNLTVDQMAAFITKLFDDPSQSSELLSEAKKLNDSQAPK

SEQ ID NO: 1353 - protein, 58 aa, ARTIFICIAL SEQUENCE
  Engineered IL-6 binding polypeptide
VDAKYAKEEYQAWTEIHTLPNLTVDQMAAFITKLFDDPSQSSELLSEAKKLNDSQAPK

SEQ ID NO: 1354 - protein, 58 aa, ARTIFICIAL SEQUENCE
  Engineered IL-6 binding polypeptide
VDAKYAKEEKDAWYEIHLLPNLTVDQMAAFITKLFDDPSQSSELLSEAKKLNDSQAPK

SEQ ID NO: 1355 - protein, 58 aa, ARTIFICIAL SEQUENCE
  Engineered IL-6 binding polypeptide
VDAKYAKEEANAWWEIHLLPNLTVEQMAAFITKLFDDPSQSSELLSEAKKLNDSQAPK

SEQ ID NO: 1356 - protein, 58 aa, ARTIFICIAL SEQUENCE
  Engineered IL-6 binding polypeptide
VDAKYAKEEAKAWHEIHILPNLTITQMAAFITKLFDDPSQSSELLSEAKKLNDSQAPK

SEQ ID NO: 1357 - protein, 58 aa, ARTIFICIAL SEQUENCE
  Engineered IL-6 binding polypeptide
VDAKYAKEEWSAWVEIHSLPNLTVSQIAAFITKLFDDPSQSSELLSEAKKLNDSQAPK

SEQ ID NO: 1358 - protein, 58 aa, ARTIFICIAL SEQUENCE
  Engineered IL-6 binding polypeptide
VDAKYAKEERRAWYEIHILPNLTVEQMAAFITKLFDDPSQSSELLSEAKKLNDSQAPK

SEQ ID NO: 1359 - protein, 58 aa, ARTIFICIAL SEQUENCE
  Engineered IL-6 binding polypeptide
VDAKYAKEEKDAWFEIHVLPNLTVDQMAAFITKLFDDPSQSSELLSEAKKLNDSQAPK

SEQ ID NO: 1360 - protein, 58 aa, ARTIFICIAL SEQUENCE
  Engineered IL-6 binding polypeptide
VDAKYAKEEKRAWLEIHNLPNLTIDQMAAFISKLFDDPSQSSELLSEAKKLNDSQAPK

SEQ ID NO: 1361 - protein, 58 aa, ARTIFICIAL SEQUENCE
  Engineered IL-6 binding polypeptide
VDAKYAKEEHGAWTEIHLLPNLTIEQVAAFITKLFDDPSQSSELLSEAKKLNDSQAPK

SEQ ID NO: 1362 - protein, 58 aa, ARTIFICIAL SEQUENCE
  Engineered IL-6 binding polypeptide
VDAKYAKEERKAWIEIHLLPNLTIEQMAAFITKLFDDPSQSSELLSEAKKLNDSQAPK

SEQ ID NO: 1363 - protein, 58 aa, ARTIFICIAL SEQUENCE
  Engineered IL-6 binding polypeptide
VDAKYAKEERSAWTEIHLLPNLTIDQMAAFITKLFDDPSQSSELLSEAKKLNDSQAPK

SEQ ID NO: 1364 - protein, 58 aa, ARTIFICIAL SEQUENCE
  Engineered IL-6 binding polypeptide
VDAKYAKEELKAWTEIHNLPNLTIDQMAAFITKLFDDPSQSSELLSEAKKLNDSQAPK

SEQ ID NO: 1365 - protein, 58 aa, ARTIFICIAL SEQUENCE
  Engineered IL-6 binding polypeptide
VDAKYAKEEANAWYEIHILPNLTVDQVAAFITKLFDDPSQSSELLSEAKKLNDSQAPK

SEQ ID NO: 1366 - protein, 58 aa, ARTIFICIAL SEQUENCE
  Engineered IL-6 binding polypeptide
VDAKYAKEEWQAWWEIHALPNLTVEQVAAFITKLFDDPSQSSELLSEAKKLNDSQAPK

SEQ ID NO: 1367 - protein, 58 aa, ARTIFICIAL SEQUENCE
  Engineered IL-6 binding polypeptide
VDAKYAKEEYNAWLEIHSLPNLTVTQMAAFITKLFDDPSQSSELLSEAKKLNDSQAPK

SEQ ID NO: 1368 - protein, 58 aa, ARTIFICIAL SEQUENCE
  Engineered IL-6 binding polypeptide
VDAKYAKEEKKAWTEIHTLPNLTVEQMAAFITKLFDDPSQSSELLSEAKKLNDSQAPK

SEQ ID NO: 1369 - protein, 58 aa, ARTIFICIAL SEQUENCE
  Engineered IL-6 binding polypeptide
VDAKYAKEEKAAWYEIHLLPNLTVVQMAAFITKLFDDPSQSSELLSEAKKLNDSQAPK

SEQ ID NO: 1370 - protein, 58 aa, ARTIFICIAL SEQUENCE
  Engineered IL-6 binding polypeptide
VDAKYAKEEKAAWREIHLLPNLTINQMAAFITKLFDDPSQSSELLSEAKKLNDSQAPK

SEQ ID NO: 1371 - protein, 58 aa, ARTIFICIAL SEQUENCE
  Engineered IL-6 binding polypeptide
VDAKYAKEEFEAWVEIHLLPNLTIEQIAAFITKLFDDPSQSSELLSEAKKLNDSQAPK

SEQ ID NO: 1372 - protein, 58 aa, ARTIFICIAL SEQUENCE
  Engineered IL-6 binding polypeptide
VDAKYAKEEYAAWVEIHNLPNLTVEQMAAFITKLFDDPSQSSELLSEAKKLNDSQAPK

SEQ ID NO: 1373 - protein, 58 aa, ARTIFICIAL SEQUENCE
  Engineered IL-6 binding polypeptide
VDAKYAKEESDAWYEIHTLPNLTINQMAAFISKLFDDPSQSSELLSEAKKLNDSQAPK

SEQ ID NO: 1374 - protein, 58 aa, ARTIFICIAL SEQUENCE
  Engineered IL-6 binding polypeptide
VDAKYAKEEKFAWTEIHILPNLTVDQMAAFITKLFDDPSQSSELLSEAKKLNDSQAPK

SEQ ID NO: 1375 - protein, 58 aa, ARTIFICIAL SEQUENCE
  Engineered IL-6 binding polypeptide
VDAKYAKEEAEAWWEIHILPNLTVSQIAAFISKLFDDPSQSSELLSEAKKLNDSQAPK

SEQ ID NO: 1376 - protein, 58 aa, ARTIFICIAL SEQUENCE
  Engineered IL-6 binding polypeptide
VDAKYAKEEYQAWFEIHLLPNLTINQMAAFISKLFDDPSQSSELLSEAKKLNDSQAPK

SEQ ID NO: 1377 - protein, 58 aa, ARTIFICIAL SEQUENCE
  Engineered IL-6 binding polypeptide
VDAKYAKEEAKAWTEIHTLPNLTVDQMAAFITKLFDDPSQSSELLSEAKKLNDSQAPK

SEQ ID NO: 1378 - protein, 58 aa, ARTIFICIAL SEQUENCE
  Engineered IL-6 binding polypeptide
VDAKYAKEEQLAWTEIHKLPNLTIDQMAAFITKLFDDPSQSSELLSEAKKLNDSQAPK

SEQ ID NO: 1379 - protein, 58 aa, ARTIFICIAL SEQUENCE
  Engineered IL-6 binding polypeptide
VDAKYAKEEYDAWTEIHLLPNLTIEQMAAFITKLFDDPSQSSELLSEAKKLNDSQAPK

SEQ ID NO: 1380 - protein, 58 aa, ARTIFICIAL SEQUENCE
  Engineered IL-6 binding polypeptide
VDAKYAKEEWDAWVEIHTLPNLTVDQMAAFITKLFDDPSQSSELLSEAKKLNDSQAPK

SEQ ID NO: 1381 - protein, 58 aa, ARTIFICIAL SEQUENCE
  Engineered IL-6 binding polypeptide
VDAKYAKEEFEAWHEIHILPNLTVQQMAAFITKLFDDPSQSSELLSEAKKLNDSQAPK

SEQ ID NO: 1382 - protein, 58 aa, ARTIFICIAL SEQUENCE
  Engineered IL-6 binding polypeptide
VDAKYAKEEWEAWVEIHNLPNLTIDQMAAFITKLFDDPSQSSELLSEAKKLNDSQAPK

SEQ ID NO: 1383 - protein, 58 aa, ARTIFICIAL SEQUENCE
  Engineered IL-6 binding polypeptide
VDAKYAKEERAAWWEIHGLPNLTVDQMAAFITKLFDDPSQSSELLSEAKKLNDSQAPK

SEQ ID NO: 1384 - protein, 58 aa, ARTIFICIAL SEQUENCE
  Engineered IL-6 binding polypeptide
VDAKYAKEERDAWHEIHRLPNLTIEQMAAFISKLFDDPSQSSELLSEAKKLNDSQAPK

SEQ ID NO: 1385 - protein, 58 aa, ARTIFICIAL SEQUENCE
  Engineered IL-6 binding polypeptide
VDAKYAKEEKTAWTEIHILPNLTIHQMAAFISKLFDDPSQSSELLSEAKKLNDSQAPK

SEQ ID NO: 1386 - protein, 58 aa, ARTIFICIAL SEQUENCE
  Engineered IL-6 binding polypeptide
VDAKYAKEEFDAWMEIHLLPNLTINQMAAFITKLFDDPSQSSELLSEAKKLNDSQAPK

SEQ ID NO: 1387 - protein, 58 aa, ARTIFICIAL SEQUENCE
  Engineered IL-6 binding polypeptide
VDAKYAKEEHLAWVEIHNLPNLTVEQMAAFITKLFDDPSQSSELLSEAKKLNDSQAPK

SEQ ID NO: 1388 - protein, 58 aa, ARTIFICIAL SEQUENCE
  Engineered IL-6 binding polypeptide
VDAKYAKEERHAWWEIHKLPNLTIEQMAAFITKLFDDPSQSSELLSEAKKLNDSQAPK

SEQ ID NO: 1389 - protein, 58 aa, ARTIFICIAL SEQUENCE
  Engineered IL-6 binding polypeptide
VDAKYAKEEYDAWFEIHLLPNLTVEQMAAFITKLFDDPSQSSELLSEAKKLNDSQAPK

SEQ ID NO: 1390 - protein, 58 aa, ARTIFICIAL SEQUENCE
  Engineered IL-6 binding polypeptide
VDAKYAKEEKWAWTEIHLLPNLTIEQMAAFISKLFDDPSQSSELLSEAKKLNDSQAPK

SEQ ID NO: 1391 - protein, 58 aa, ARTIFICIAL SEQUENCE
  Engineered IL-6 binding polypeptide
VDAKYAKEEAKAWFEIHILPNLTIEQIAAFITKLFDDPSQSSELLSEAKKLNDSQAPK

SEQ ID NO: 1392 - protein, 58 aa, ARTIFICIAL SEQUENCE
  Engineered IL-6 binding polypeptide
VDAKYAKEEYRAWTEIHLLPNLTIHQMAAFITKLFDDPSQSSELLSEAKKLNDSQAPK

SEQ ID NO: 1393 - protein, 58 aa, ARTIFICIAL SEQUENCE
  Engineered IL-6 binding polypeptide
VDAKYAKEEKHAWTEIHILPNLTVEQMAAFITKLFDDPSQSSELLSEAKKLNDSQAPK

SEQ ID NO: 1394 - protein, 58 aa, ARTIFICIAL SEQUENCE
  Engineered IL-6 binding polypeptide
VDAKYAKEEARAWTEIHTLPNLTIDQIAAFITKLFDDPSQSSELLSEAKKLNDSQAPK

SEQ ID NO: 1395 - protein, 58 aa, ARTIFICIAL SEQUENCE
  Engineered IL-6 binding polypeptide
VDAKYAKEEYAAWVEIHSLPNLTVDQMAAFITKLFDDPSQSSELLSEAKKLNDSQAPK

SEQ ID NO: 1396 - protein, 58 aa, ARTIFICIAL SEQUENCE
  Engineered IL-6 binding polypeptide
VDAKYAKEEYDAWYEIHLLPNLTINQMAAFITKLFDDPSQSSELLSEAKKLNDSQAPK

SEQ ID NO: 1397 - protein, 58 aa, ARTIFICIAL SEQUENCE
  Engineered IL-6 binding polypeptide
VDAKYAKEEFNAWNEIHLLPNLTVTQMAAFITKLFDDPSQSSELLSEAKKLNDSQAPK

SEQ ID NO: 1398 - protein, 58 aa, ARTIFICIAL SEQUENCE
  Engineered IL-6 binding polypeptide
VDAKYAKEEKAAWNEIHLLPNLTIDQMAAFISKLFDDPSQSSELLSEAKKLNDSQAPK

SEQ ID NO: 1399 - protein, 58 aa, ARTIFICIAL SEQUENCE
  Engineered IL-6 binding polypeptide
VDAKYAKEERIAWFEIHILPNLTIKQMAAFISKLFDDPSQSSELLSEAKKLNDSQAPK

SEQ ID NO: 1400 - protein, 58 aa, ARTIFICIAL SEQUENCE
  Engineered IL-6 binding polypeptide
VDAKYAKEEYKAWYEIHILPNLTVQQMAAFITKLFDDPSQSSELLSEAKKLNDSQAPK

SEQ ID NO: 1401 - protein, 58 aa, ARTIFICIAL SEQUENCE
  Engineered IL-6 binding polypeptide
VDAKYAKEEQHAWYEIHILPNLTIDQMAAFITKLFDDPSQSSELLSEAKKLNDSQAPK

SEQ ID NO: 1402 - protein, 58 aa, ARTIFICIAL SEQUENCE
  Engineered IL-6 binding polypeptide
VDAKYAKEERYAWFEIHALPNLTVSQMAAFITKLFDDPSQSSELLSEAKKLNDSQAPK

SEQ ID NO: 1403 - protein, 58 aa, ARTIFICIAL SEQUENCE
  Engineered IL-6 binding polypeptide
VDAKYAKEEYKAWIEIHLLPNLTIDQIAAFISKLFDDPSQSSELLSEAKKLNDSQAPK

SEQ ID NO: 1404 - protein, 58 aa, ARTIFICIAL SEQUENCE
  Engineered IL-6 binding polypeptide
VDAKYAKEERTAWFEIHLLPNLTVDQIAAFITKLFDDPSQSSELLSEAKKLNDSQAPK

SEQ ID NO: 1405 - protein, 58 aa, ARTIFICIAL SEQUENCE
  Engineered IL-6 binding polypeptide
VDAKYAKEEKHAWWEIHKLPNLTINQMAAFITKLFDDPSQSSELLSEAKKLNDSQAPK

SEQ ID NO: 1406 - protein, 58 aa, ARTIFICIAL SEQUENCE
  Engineered IL-6 binding polypeptide
VDAKYAKEEKMAWFEIHVLPNLTISQIAAFITKLFDDPSQSSELLSEAKKLNDSQAPK

SEQ ID NO: 1407 - protein, 58 aa, ARTIFICIAL SEQUENCE
  Engineered IL-6 binding polypeptide
VDAKYAKEEFDAWTEIHLLPNLTVDQMAAFISKLFDDPSQSSELLSEAKKLNDSQAPK

SEQ ID NO: 1408 - protein, 58 aa, ARTIFICIAL SEQUENCE
  Engineered IL-6 binding polypeptide
VDAKYAKEERDAWFEIHRLPNLTVSQMAAFITKLFDDPSQSSELLSEAKKLNDSQAPK

SEQ ID NO: 1409 - protein, 58 aa, ARTIFICIAL SEQUENCE
  Engineered IL-6 binding polypeptide
VDAKYAKEEAVAWTEIHLLPNLTIDQMAAFITKLFDDPSQSSELLSEAKKLNDSQAPK

SEQ ID NO: 1410 - protein, 58 aa, ARTIFICIAL SEQUENCE
  Engineered IL-6 binding polypeptide
VDAKYAKEEWYAWREIHILPNLTVEQVAAFITKLFDDPSQSSELLSEAKKLNDSQAPK

SEQ ID NO: 1411 - protein, 58 aa, ARTIFICIAL SEQUENCE
  Engineered IL-6 binding polypeptide
VDAKYAKEEFHAWYEIHILPNLTVDQMAAFITKLFDDPSQSSELLSEAKKLNDSQAPK

SEQ ID NO: 1412 - protein, 58 aa, ARTIFICIAL SEQUENCE
  Engineered IL-6 binding polypeptide
VDAKYAKEEYEAWTEIHLLPNLTIDQMAAFITKLFDDPSQSSELLSEAKKLNDSQAPK

SEQ ID NO: 1413 - protein, 58 aa, ARTIFICIAL SEQUENCE
  Engineered IL-6 binding polypeptide
VDAKYAKEEWDAWTEIHALPNLTIDQMAAFITKLFDDPSQSSELLSEAKKLNDSQAPK

SEQ ID NO: 1414 - protein, 58 aa, ARTIFICIAL SEQUENCE
  Engineered IL-6 binding polypeptide
VDAKYAKEESEAWTEIHLLPNLTIDQMAAFITKLFDDPSQSSELLSEAKKLNDSQAPK

SEQ ID NO: 1415 - protein, 58 aa, ARTIFICIAL SEQUENCE
  Engineered IL-6 binding polypeptide
VDAKYAKEEFTAWSEIHNLPNLTVEQMAAFITKLFDDPSQSSELLSEAKKLNDSQAPK

SEQ ID NO: 1416 - protein, 58 aa, ARTIFICIAL SEQUENCE
  Engineered IL-6 binding polypeptide
VDAKYAKEEADAWHEIHILPNLTVEQMAAFITKLFDDPSQSSELLSEAKKLNDSQAPK

SEQ ID NO: 1417 - protein, 58 aa, ARTIFICIAL SEQUENCE
  Engineered IL-6 binding polypeptide
VDAKYAKEEKAAWFEIHILPNLTVDQMAAFITKLFDDPSQSSELLSEAKKLNDSQAPK

SEQ ID NO: 1418 - protein, 58 aa, ARTIFICIAL SEQUENCE
  Engineered IL-6 binding polypeptide
VDAKYAKEERRAWHEIHILPNLTVEQMAAFISKLFDDPSQSSELLSEAKKLNDSQAPK

SEQ ID NO: 1419 - protein, 58 aa, ARTIFICIAL SEQUENCE
  Engineered IL-6 binding polypeptide
VDAKYAKEERDAWWEIHKLPNLTVDQMAAFITKLFDDPSQSSELLSEAKKLNDSQAPK

SEQ ID NO: 1420 - protein, 58 aa, ARTIFICIAL SEQUENCE
  Engineered IL-6 binding polypeptide
VDAKYAKEEAYAWKEIHILPNLTIDQMAAFISKLFDDPSQSSELLSEAKKLNDSQAPK

SEQ ID NO: 1421 - protein, 58 aa, ARTIFICIAL SEQUENCE
  Engineered IL-6 binding polypeptide
VDAKYAKEERAAWTEIHNLPNLTIDQMAAFITKLFDDPSQSSELLSEAKKLNDSQAPK

SEQ ID NO: 1422 - protein, 58 aa, ARTIFICIAL SEQUENCE
  Engineered IL-6 binding polypeptide
VDAKYAKEEYAAWTEIHKLPNLTIDQMAAFITKLFDDPSQSSELLSEAKKLNDSQAPK

SEQ ID NO: 1423 - protein, 58 aa, ARTIFICIAL SEQUENCE
  Engineered IL-6 binding polypeptide
VDAKYAKEERTAWMEIHGLPNLTIEQMAAFISKLFDDPSQSSELLSEAKKLNDSQAPK

SEQ ID NO: 1424 - protein, 58 aa, ARTIFICIAL SEQUENCE
  Engineered IL-6 binding polypeptide
VDAKYAKEEWTAWNEIHLLPNLTIEQMAAFITKLFDDPSQSSELLSEAKKLNDSQAPK

SEQ ID NO: 1425 - protein, 58 aa, ARTIFICIAL SEQUENCE
  Engineered IL-6 binding polypeptide
VDAKYAKEEKDAWFEIHILPNLTVHQIAAFISKLFDDPSQSSELLSEAKKLNDSQAPK

SEQ ID NO: 1426 - protein, 58 aa, ARTIFICIAL SEQUENCE
  Engineered IL-6 binding polypeptide
VDAKYAKEEKSAWREIHLLPNLTIEQMAAFISKLFDDPSQSSELLSEAKKLNDSQAPK

SEQ ID NO: 1427 - protein, 58 aa, ARTIFICIAL SEQUENCE
  Engineered IL-6 binding polypeptide
VDAKYAKEEYTAWLEIHALPNLTITQMAAFITKLFDDPSQSSELLSEAKKLNDSQAPK

SEQ ID NO: 1428 - protein, 58 aa, ARTIFICIAL SEQUENCE
  Engineered IL-6 binding polypeptide
VDAKYAKEEKMAWMEIHKLPNLTIDQMAAFITKLFDDPSQSSELLSEAKKLNDSQAPK

SEQ ID NO: 1429 - protein, 58 aa, ARTIFICIAL SEQUENCE
  Engineered IL-6 binding polypeptide
VDAKYAKEEYHAWYEIHLLPNLTVEQIAAFITKLFDDPSQSSELLSEAKKLNDSQAPK

SEQ ID NO: 1430 - protein, 58 aa, ARTIFICIAL SEQUENCE
  Engineered IL-6 binding polypeptide
VDAKYAKEEKDAWFEIHALPNLTVDQMAAFISKLFDDPSQSSELLSEAKKLNDSQAPK

SEQ ID NO: 1431 - protein, 58 aa, ARTIFICIAL SEQUENCE
  Engineered IL-6 binding polypeptide
VDAKYAKEERAAWFEIHLLPNLTVEQMAAFITKLFDDPSQSSELLSEAKKLNDSQAPK

SEQ ID NO: 1432 - protein, 58 aa, ARTIFICIAL SEQUENCE
  Engineered IL-6 binding polypeptide
VDAKYAKEEYMAWLEIHNLPNLTVEQMAAFITKLFDDPSQSSELLSEAKKLNDSQAPK

SEQ ID NO: 1433 - protein, 58 aa, ARTIFICIAL SEQUENCE
  Engineered IL-6 binding polypeptide
VDAKYAKEEYIAWREIHLLPNLTIDQMAAFITKLFDDPSQSSELLSEAKKLNDSQAPK

SEQ ID NO: 1434 - protein, 58 aa, ARTIFICIAL SEQUENCE
  Engineered IL-6 binding polypeptide
VDAKYAKEEKAAWHEIHVLPNLTISQMAAFITKLFDDPSQSSELLSEAKKLNDSQAPK

SEQ ID NO: 1435 - protein, 58 aa, ARTIFICIAL SEQUENCE
  Engineered IL-6 binding polypeptide
VDAKYAKEEWQAWNEIHLLPNLTIDQMAAFISKLFDDPSQSSELLSEAKKLNDSQAPK

SEQ ID NO: 1436 - protein, 58 aa, ARTIFICIAL SEQUENCE
  Engineered IL-6 binding polypeptide
VDAKYAKEEWEAWFEIHLLPNLTISQMAAFITKLFDDPSQSSELLSEAKKLNDSQAPK

SEQ ID NO: 1437 - protein, 58 aa, ARTIFICIAL SEQUENCE
  Engineered IL-6 binding polypeptide
VDAKYAKEEYHAWWEIHKLPNLTISQMAAFITKLFDDPSQSSELLSEAKKLNDSQAPK

SEQ ID NO: 1438 - protein, 58 aa, ARTIFICIAL SEQUENCE
  Engineered IL-6 binding polypeptide
VDAKYAKEEYAAWVEIHALPNLTVEQMAAFITKLFDDPSQSSELLSEAKKLNDSQAPK

SEQ ID NO: 1439 - protein, 58 aa, ARTIFICIAL SEQUENCE
  Engineered IL-6 binding polypeptide
VDAKYAKEERMAWHEIHILPNLTVQQMAAFISKLFDDPSQSSELLSEAKKLNDSQAPK

SEQ ID NO: 1440 - protein, 58 aa, ARTIFICIAL SEQUENCE
  Engineered IL-6 binding polypeptide
VDAKYAKEERDAWYEIHNLPNLTIDQMAAFISKLFDDPSQSSELLSEAKKLNDSQAPK

SEQ ID NO: 1441 - protein, 58 aa, ARTIFICIAL SEQUENCE
  Engineered IL-6 binding polypeptide
VDAKYAKEESYAWWEIHKLPNLTVEQMAAFISKLFDDPSQSSELLSEAKKLNDSQAPK

SEQ ID NO: 1442 - protein, 58 aa, ARTIFICIAL SEQUENCE
  Engineered IL-6 binding polypeptide
VDAKYAKEEKRAWKEIHILPNLTINQMAAFITKLFDDPSQSSELLSEAKKLNDSQAPK

SEQ ID NO: 1443 - protein, 58 aa, ARTIFICIAL SEQUENCE
  Engineered IL-6 binding polypeptide
VDAKYAKEEKEAWFEIHALPNLTVEQIAAFITKLFDDPSQSSELLSEAKKLNDSQAPK

SEQ ID NO: 1444 - protein, 58 aa, ARTIFICIAL SEQUENCE
  Engineered IL-6 binding polypeptide
VDAKYAKEEYEAWNEIHKLPNLTVSQMAAFISKLFDDPSQSSELLSEAKKLNDSQAPK

SEQ ID NO: 1445 - protein, 58 aa, ARTIFICIAL SEQUENCE
  Engineered IL-6 binding polypeptide
VDAKYAKEEAAAWMEIHLLPNLTIDQMAAFITKLFDDPSQSSELLSEAKKLNDSQAPK

SEQ ID NO: 1446 - protein, 58 aa, ARTIFICIAL SEQUENCE
  Engineered IL-6 binding polypeptide
VDAKYAKEERNAWEEIHLLPNLTINQIAAFITKLFDDPSQSSELLSEAKKLNDSQAPK

SEQ ID NO: 1447 - protein, 58 aa, ARTIFICIAL SEQUENCE
  Engineered IL-6 binding polypeptide
VDAKYAKEEAYAWHEIHILPNLTVDQMAAFITKLFDDPSQSSELLSEAKKLNDSQAPK

SEQ ID NO: 1448 - protein, 58 aa, ARTIFICIAL SEQUENCE
  Engineered IL-6 binding polypeptide
VDAKYAKEEANAWFEIHVLPNLTVEQMAAFITKLFDDPSQSSELLSEAKKLNDSQAPK

SEQ ID NO: 1449 - protein, 58 aa, ARTIFICIAL SEQUENCE
  Engineered IL-6 binding polypeptide
VDAKYAKEEKNAWTEIHKLPNLTVDQMAAFITKLFDDPSQSSELLSEAKKLNDSQAPK

SEQ ID NO: 1450 - protein, 58 aa, ARTIFICIAL SEQUENCE
  Engineered IL-6 binding polypeptide
VDAKYAKEEYDAWYEIHLLPNLTISQMAAFISKLFDDPSQSSELLSEAKKLNDSQAPK

SEQ ID NO: 1451 - protein, 58 aa, ARTIFICIAL SEQUENCE
  Engineered IL-6 binding polypeptide
VDAKYAKEERLAWAEIHKLPNLTIEQVAAFISKLFDDPSQSSELLSEAKKLNDSQAPK

SEQ ID NO: 1452 - protein, 58 aa, ARTIFICIAL SEQUENCE
  Engineered IL-6 binding polypeptide
VDAKYAKEERAAWNEIHILPNLTVQQMAAFITKLFDDPSQSSELLSEAKKLNDSQAPK

SEQ ID NO: 1453 - protein, 58 aa, ARTIFICIAL SEQUENCE
  Engineered IL-6 binding polypeptide
VDAKYAKEEAAAWDEIHRLPNLTVDQIAAFITKLFDDPSQSSELLSEAKKLNDSQAPK

SEQ ID NO: 1454 - protein, 58 aa, ARTIFICIAL SEQUENCE
  Engineered IL-6 binding polypeptide
VDAKYAKEEKEAWWEIHGLPNLTVNQMAAFITKLFDDPSQSSELLSEAKKLNDSQAPK

SEQ ID NO: 1455 - protein, 58 aa, ARTIFICIAL SEQUENCE
  Engineered IL-6 binding polypeptide
VDAKYAKEERKAWYEIHTLPNLTINQMAAFITKLFDDPSQSSELLSEAKKLNDSQAPK

SEQ ID NO: 1456 - protein, 58 aa, ARTIFICIAL SEQUENCE
  Engineered IL-6 binding polypeptide
VDAKYAKEERNAWYEIHILPNLTIEQMAAFITKLFDDPSQSSELLSEAKKLNDSQAPK

SEQ ID NO: 1457 - protein, 58 aa, ARTIFICIAL SEQUENCE
  Engineered IL-6 binding polypeptide
VDAKYAKEEKLAWMEIHLLPNLTIEQMAAFITKLFDDPSQSSELLSEAKKLNDSQAPK

SEQ ID NO: 1458 - protein, 58 aa, ARTIFICIAL SEQUENCE
  Engineered IL-6 binding polypeptide
VDAKYAKEEYMAWLEIHNLPNLTVDQMAAFITKLFDDPSQSSELLSEAKKLNDSQAPK

SEQ ID NO: 1459 - protein, 58 aa, ARTIFICIAL SEQUENCE
  Engineered IL-6 binding polypeptide
VDAKYAKEESDAWREIHLLPNLTIEQMAAFISKLFDDPSQSSELLSEAKKLNDSQAPK

SEQ ID NO: 1460 - protein, 58 aa, ARTIFICIAL SEQUENCE
  Engineered IL-6 binding polypeptide
VDAKYAKEEKEAWYEIHQLPNLTVNQMAAFISKLFDDPSQSSELLSEAKKLNDSQAPK

SEQ ID NO: 1461 - protein, 58 aa, ARTIFICIAL SEQUENCE
  Engineered IL-6 binding polypeptide
VDAKYAKEEKQAWYEIHNLPNLTINQMAAFITKLFDDPSQSSELLSEAKKLNDSQAPK

SEQ ID NO: 1462 - protein, 58 aa, ARTIFICIAL SEQUENCE
  Engineered IL-6 binding polypeptide
VDAKYAKEEYEAWTEIHRLPNLTIDQMAAFITKLFDDPSQSSELLSEAKKLNDSQAPK

SEQ ID NO: 1463 - protein, 58 aa, ARTIFICIAL SEQUENCE
  Engineered IL-6 binding polypeptide
VDAKYAKEEKDAWYEIHVLPNLTISQMAAFITKLFDDPSQSSELLSEAKKLNDSQAPK

SEQ ID NO: 1464 - protein, 58 aa, ARTIFICIAL SEQUENCE
  Engineered IL-6 binding polypeptide
VDAKYAKEERIAWYEIHILPNLTISQMAAFITKLFDDPSQSSELLSEAKKLNDSQAPK

SEQ ID NO: 1465 - protein, 58 aa, ARTIFICIAL SEQUENCE
  Engineered IL-6 binding polypeptide
VDAKYAKEEQYAWTEIHKLPNLTIDQMAAFITKLFDDPSQSSELLSEAKKLNDSQAPK

SEQ ID NO: 1466 - protein, 58 aa, ARTIFICIAL SEQUENCE
  Engineered IL-6 binding polypeptide
VDAKYAKEESDAWWEIHKLPNLTIDQMAAFITKLFDDPSQSSELLSEAKKLNDSQAPK

SEQ ID NO: 1467 - protein, 58 aa, ARTIFICIAL SEQUENCE
  Engineered IL-6 binding polypeptide
VDAKYAKEEKFAWNEIHLLPNLTIEQMAAFITKLFDDPSQSSELLSEAKKLNDSQAPK

SEQ ID NO: 1468 - protein, 58 aa, ARTIFICIAL SEQUENCE
  Engineered IL-6 binding polypeptide
VDAKYAKEERAAWYEIHLLPNLTVNQIAAFITKLFDDPSQSSELLSEAKKLNDSQAPK

SEQ ID NO: 1469 - protein, 58 aa, ARTIFICIAL SEQUENCE
  Engineered IL-6 binding polypeptide
VDAKYAKEEFHAWWEIHKLPNLTVEQVAAFITKLFDDPSQSSELLSEAKKLNDSQAPK

SEQ ID NO: 1470 - protein, 58 aa, ARTIFICIAL SEQUENCE
  Engineered IL-6 binding polypeptide
VDAKYAKEEKQAWLEIHILPNLTVGQIAAFITKLFDDPSQSSELLSEAKKLNDSQAPK

SEQ ID NO: 1471 - protein, 58 aa, ARTIFICIAL SEQUENCE
  Engineered IL-6 binding polypeptide
VDAKYAKEEHLAWTEIHLLPNLTINQMAAFITKLFDDPSQSSELLSEAKKLNDSQAPK

SEQ ID NO: 1472 - protein, 58 aa, ARTIFICIAL SEQUENCE
  Engineered IL-6 binding polypeptide
VDAKYAKEEATAWREIHLLPNLTINQMAAFITKLFDDPSQSSELLSEAKKLNDSQAPK

SEQ ID NO: 1473 - protein, 58 aa, ARTIFICIAL SEQUENCE
  Engineered IL-6 binding polypeptide
VDAKYAKEEKRAWYEIHILPNLTVEQVAAFITKLFDDPSQSSELLSEAKKLNDSQAPK

SEQ ID NO: 1474 - protein, 58 aa, ARTIFICIAL SEQUENCE
  Engineered IL-6 binding polypeptide
VDAKYAKEEYEAWTEIHLLPNLTVSQMAAFITKLFDDPSQSSELLSEAKKLNDSQAPK

SEQ ID NO: 1475 - protein, 58 aa, ARTIFICIAL SEQUENCE
  Engineered IL-6 binding polypeptide
VDAKYAKEESNAWWEIHKLPNLTVNQVAAFITKLFDDPSQSSELLSEAKKLNDSQAPK

SEQ ID NO: 1476 - protein, 58 aa, ARTIFICIAL SEQUENCE
  Engineered IL-6 binding polypeptide
VDAKYAKEEKRAWMEIHLLPNLTVDQIAAFITKLFDDPSQSSELLSEAKKLNDSQAPK

SEQ ID NO: 1477 - protein, 58 aa, ARTIFICIAL SEQUENCE
  Engineered IL-6 binding polypeptide
VDAKYAKEEKFAWKEIHILPNLTVDQIAAFITKLFDDPSQSSELLSEAKKLNDSQAPK

SEQ ID NO: 1478 - protein, 58 aa, ARTIFICIAL SEQUENCE
  Engineered IL-6 binding polypeptide
VDAKYAKEERDAWFEIHVLPNLTILQMAAFITKLFDDPSQSSELLSEAKKLNDSQAPK

SEQ ID NO: 1479 - protein, 58 aa, ARTIFICIAL SEQUENCE
  Engineered IL-6 binding polypeptide
VDAKYAKEEHYAWTEIHILPNLTVNQMAAFITKLFDDPSQSSELLSEAKKLNDSQAPK

SEQ ID NO: 1480 - protein, 58 aa, ARTIFICIAL SEQUENCE
  Engineered IL-6 binding polypeptide
VDAKYAKEEKRAWMEIHLLPNLTVHQMAAFITKLFDDPSQSSELLSEAKKLNDSQAPK

SEQ ID NO: 1481 - protein, 58 aa, ARTIFICIAL SEQUENCE
  Engineered IL-6 binding polypeptide
VDAKYAKEEYDAWVEIHLLPNLTVEQMAAFITKLFDDPSQSSELLSEAKKLNDSQAPK

SEQ ID NO: 1482 - protein, 58 aa, ARTIFICIAL SEQUENCE
  Engineered IL-6 binding polypeptide
VDAKYAKEEHTAWFEIHILPNLTISQIAAFITKLFDDPSQSSELLSEAKKLNDSQAPK

SEQ ID NO: 1483 - protein, 58 aa, ARTIFICIAL SEQUENCE
  Engineered IL-6 binding polypeptide
VDAKYAKEELQAWKEIHILPNLTVDQIAAFITKLFDDPSQSSELLSEAKKLNDSQAPK

SEQ ID NO: 1484 - protein, 58 aa, ARTIFICIAL SEQUENCE
  Engineered IL-6 binding polypeptide
VDAKYAKEEYDAWLEIHLLPNLTISQMAAFITKLFDDPSQSSELLSEAKKLNDSQAPK

SEQ ID NO: 1485 - protein, 58 aa, ARTIFICIAL SEQUENCE
  Engineered IL-6 binding polypeptide
VDAKYAKEEARAWREIHILPNLTVEQMAAFITKLFDDPSQSSELLSEAKKLNDSQAPK

SEQ ID NO: 1486 - protein, 58 aa, ARTIFICIAL SEQUENCE
  Engineered IL-6 binding polypeptide
VDAKYAKEERNAWFEIHILPNLTIDQMAAFITKLFDDPSQSSELLSEAKKLNDSQAPK

SEQ ID NO: 1487 - protein, 58 aa, ARTIFICIAL SEQUENCE
  Engineered IL-6 binding polypeptide
VDAKYAKEEAYAWHEIHVLPNLTIDQMAAFITKLFDDPSQSSELLSEAKKLNDSQAPK

SEQ ID NO: 1488 - protein, 58 aa, ARTIFICIAL SEQUENCE
  Engineered IL-6 binding polypeptide
VDAKYAKEEYFAWTEIHKLPNLTINQMAAFITKLFDDPSQSSELLSEAKKLNDSQAPK

SEQ ID NO: 1489 - protein, 58 aa, ARTIFICIAL SEQUENCE
  Engineered IL-6 binding polypeptide
VDAKYAKEEAGAWYEIHLLPNLTVEQMAAFITKLFDDPSQSSELLSEAKKLNDSQAPK

SEQ ID NO: 1490 - protein, 58 aa, ARTIFICIAL SEQUENCE
  Engineered IL-6 binding polypeptide
VDAKYAKEEKKAWYEIHILPNLTIEQMAAFISKLFDDPSQSSELLSEAKKLNDSQAPK

SEQ ID NO: 1491 - protein, 58 aa, ARTIFICIAL SEQUENCE
  Engineered IL-6 binding polypeptide
VDAKYAKEEKQAWFEIHLLPNLTIEQMAAFISKLFDDPSQSSELLSEAKKLNDSQAPK

SEQ ID NO: 1492 - protein, 58 aa, ARTIFICIAL SEQUENCE
  Engineered IL-6 binding polypeptide
VDAKYAKEEWHAWLEIHNLPNLTIEQMAAFISKLFDDPSQSSELLSEAKKLNDSQAPK

SEQ ID NO: 1493 - protein, 58 aa, ARTIFICIAL SEQUENCE
  Engineered IL-6 binding polypeptide
VDAKYAKEEKSAWIEIHNLPNLTINQMAAFITKLFDDPSQSSELLSEAKKLNDSQAPK

SEQ ID NO: 1494 - protein, 58 aa, ARTIFICIAL SEQUENCE
  Engineered IL-6 binding polypeptide
VDAKYAKEEYQAWNEIHILPNLTINQIAAFITKLFDDPSQSSELLSEAKKLNDSQAPK

SEQ ID NO: 1495 - protein, 58 aa, ARTIFICIAL SEQUENCE
  Engineered IL-6 binding polypeptide
VDAKYAKEEAYAWVEIHKLPNLTVTQVAAFISKLFDDPSQSSELLSEAKKLNDSQAPK

SEQ ID NO: 1496 - protein, 58 aa, ARTIFICIAL SEQUENCE
  Engineered IL-6 binding polypeptide
VDAKYAKEEYDAWMEIHNLPNLTIEQMAAFITKLFDDPSQSSELLSEAKKLNDSQAPK

SEQ ID NO: 1497 - protein, 58 aa, ARTIFICIAL SEQUENCE
  Engineered IL-6 binding polypeptide
VDAKYAKEEYEAWVEIHNLPNLTIEQMAAFITKLFDDPSQSSELLSEAKKLNDSQAPK

SEQ ID NO: 1498 - protein, 58 aa, ARTIFICIAL SEQUENCE
  Engineered IL-6 binding polypeptide
VDAKYAKEEREAWNEIHLLPNLTIEQIAAFITKLFDDPSQSSELLSEAKKLNDSQAPK

SEQ ID NO: 1499 - protein, 58 aa, ARTIFICIAL SEQUENCE
  Engineered IL-6 binding polypeptide
VDAKYAKEEKRAWYEIHILPNLTVGQMAAFISKLFDDPSQSSELLSEAKKLNDSQAPK

SEQ ID NO: 1500 - protein, 58 aa, ARTIFICIAL SEQUENCE
  Engineered IL-6 binding polypeptide
VDAKYAKEEKEAWTEIHILPNLTVEQMAAFITKLFDDPSQSSELLSEAKKLNDSQAPK

SEQ ID NO: 1501 - protein, 58 aa, ARTIFICIAL SEQUENCE
  Engineered IL-6 binding polypeptide
VDAKYAKEEFEAWFEIHKLPNLTVEQMAAFITKLFDDPSQSSELLSEAKKLNDSQAPK

SEQ ID NO: 1502 - protein, 58 aa, ARTIFICIAL SEQUENCE
  Engineered IL-6 binding polypeptide
VDAKYAKEESQAWTEIHLLPNLTIEQMAAFISKLFDDPSQSSELLSEAKKLNDSQAPK

SEQ ID NO: 1503 - protein, 58 aa, ARTIFICIAL SEQUENCE
  Engineered IL-6 binding polypeptide
VDAKYAKEERKAWFEIHLLPNLTTQQRSAFISKLFDDPSQSSELLSEAKKLNDSQAPK

SEQ ID NO: 1504 - protein, 58 aa, ARTIFICIAL SEQUENCE
  Engineered IL-6 binding polypeptide
VDAKYAKEERSAWFEIHTLPNLTVQQIAAFIWKLYDDPSQSSELLSEAKKLNDSQAPK

SEQ ID NO: 1505 - protein, 58 aa, ARTIFICIAL SEQUENCE
  Engineered IL-6 binding polypeptide
VDAKYAKEERQAWWEIHSLPNLTVDQMAAFIVKLMDDPSQSSELLSEAKKLNDSQAPK

SEQ ID NO: 1506 - protein, 58 aa, ARTIFICIAL SEQUENCE
  Engineered IL-6 binding polypeptide
VDAKYAKEQAKAWWEIHVLPNLTVHQVAAFITKLFDDPSQSSELLSEAKKLNDSQAPK

SEQ ID NO: 1507 - protein, 58 aa, ARTIFICIAL SEQUENCE
  Engineered IL-6 binding polypeptide
VDAKYAKEERDAWHEIQILPNLTITQMAAFISKLFDDPSQSSELLSEAKKLNDSQAPK

SEQ ID NO: 1508 - protein, 58 aa, ARTIFICIAL SEQUENCE
  Engineered IL-6 binding polypeptide
VDAKYAKEEQRAWTEIHVLPNLTVQQMAAFITKLFDDPSQSSELLSEAKKLNDSQAPK

SEQ ID NO: 1509 - protein, 58 aa, ARTIFICIAL SEQUENCE
  Engineered IL-6 binding polypeptide
VDAKYAKETQHAWWEIHKLPNLTVSQMAAFITKLFDDPSQSSELLSEAKKLNDSQAPK

SEQ ID NO: 1510 - protein, 58 aa, ARTIFICIAL SEQUENCE
  Engineered IL-6 binding polypeptide
VDAKYAKEDRTAWWEIHKLPNLTAEQMAAFITKLFDDPSQSSELLSEAKKLNDSQAPK

SEQ ID NO: 1511 - protein, 58 aa, ARTIFICIAL SEQUENCE
  Engineered IL-6 binding polypeptide
VDAKYAKEERDAWREIHALPNLTVDQLVAFITKLFDDPSQSSELLSEAKKLNDSQAPK

SEQ ID NO: 1512 - protein, 58 aa, ARTIFICIAL SEQUENCE
  Engineered IL-6 binding polypeptide
VDAKYAKEEQRAWREIHLLPNLTIEQMAAFIWKLLDDPSQSSELLSEAKKLNDSQAPK

SEQ ID NO: 1513 - protein, 58 aa, ARTIFICIAL SEQUENCE
  Engineered IL-6 binding polypeptide
VDAKYAKEEQRAWTEIHVLPNLTVSQMSAFISKLFDDPSQSSELLSEAKKLNDSQAPK

SEQ ID NO: 1514 - protein, 58 aa, ARTIFICIAL SEQUENCE
  Engineered IL-6 binding polypeptide
VDAKYAKEQHQAWNEIHLLPNLTVNQMAAFIVKLFDDPSQSSELLSEAKKLNDSQAPK

SEQ ID NO: 1515 - protein, 58 aa, ARTIFICIAL SEQUENCE
  Engineered IL-6 binding polypeptide
VDAKYAKEEHAAWLEIHLLPNLTVKQMAAFIGKLMDDPSQSSELLSEAKKLNDSQAPK

SEQ ID NO: 1516 - protein, 58 aa, ARTIFICIAL SEQUENCE
  Engineered IL-6 binding polypeptide
VDAKYAKEEQMAWFEIHLLPNLTVGQMAAFIQKLFDDPSQSSELLSEAKKLNDSQAPK

SEQ ID NO: 1517 - protein, 58 aa, ARTIFICIAL SEQUENCE
  Engineered IL-6 binding polypeptide
VDAKYAKEERSAWFEIHILPNLTISQKSAFIVKLFDDPSQSSELLSEAKKLNDSQAPK

SEQ ID NO: 1518 - protein, 58 aa, ARTIFICIAL SEQUENCE
  Engineered IL-6 binding polypeptide
VDAKYAKEERSAWYEIHLLPNLTADQMAAFIAKLFDDPSQSSELLSEAKKLNDSQAPK

SEQ ID NO: 1519 - protein, 58 aa, ARTIFICIAL SEQUENCE
  Engineered IL-6 binding polypeptide
VDAKYAKEEQRAWYEIHLLPNLTIEQLTAFIMKLMDDPSQSSELLSEAKKLNDSQAPK

SEQ ID NO: 1520 - protein, 58 aa, ARTIFICIAL SEQUENCE
  Engineered IL-6 binding polypeptide
VDAKYAKEERQAWWEITILPNLTIEQVAAFITKLFDDPSQSSELLSEAKKLNDSQAPK

SEQ ID NO: 1521 - protein, 58 aa, ARTIFICIAL SEQUENCE
  Engineered IL-6 binding polypeptide
VDAKYAKEDYEAWVEIHVLPNLTVEQKAAFIVKLFDDPSQSSELLSEAKKLNDSQAPK

SEQ ID NO: 1522 - protein, 58 aa, ARTIFICIAL SEQUENCE
  Engineered IL-6 binding polypeptide
VDAKYAKEVYNAWHEIHVLPNLTTLQISAFISKLFDDPSQSSELLSEAKKLNDSQAPK

SEQ ID NO: 1523 - protein, 58 aa, ARTIFICIAL SEQUENCE
  Engineered IL-6 binding polypeptide
VDAKYAKEERKAWWEIHLLPNLTVRQTAAFIWKLLDDPSQSSELLSEAKKLNDSQAPK

SEQ ID NO: 1524 - protein, 58 aa, ARTIFICIAL SEQUENCE
  Engineered IL-6 binding polypeptide
VDAKYAKEEQAAWWEIHMLPNLTIEQRTAFIIKLFDDPSQSSELLSEAKKLNDSQAPK

SEQ ID NO: 1525 - protein, 58 aa, ARTIFICIAL SEQUENCE
  Engineered IL-6 binding polypeptide
VDAKYAKEEQTAWFEIHILPNLTVNQRVAFITKLFDDPSQSSELLSEAKKLNDSQAPK

SEQ ID NO: 1526 - protein, 58 aa, ARTIFICIAL SEQUENCE
  Engineered IL-6 binding polypeptide
VDAKYAKEEALAWREIHLLPNLTTVQISAFIAKLLDDPSQSSELLSEAKKLNDSQAPK

SEQ ID NO: 1527 - protein, 58 aa, ARTIFICIAL SEQUENCE
  Engineered IL-6 binding polypeptide
VDAKYAKEEKFAWTEIHLLPNLTIGQQAAFIWKLFDDPSQSSELLSEAKKLNDSQAPK

SEQ ID NO: 1528 - protein, 58 aa, ARTIFICIAL SEQUENCE
  Engineered IL-6 binding polypeptide
VDAKYAKEERAAWWEIHVLPNLTVSQMYAFITKLFDDPSQSSELLSEAKKLNDSQAPK

SEQ ID NO: 1529 - protein, 58 aa, ARTIFICIAL SEQUENCE
  Engineered IL-6 binding polypeptide
VDAKYAKEEQRAWYEIHLLPNLTVRQRGAFITKLFDDPSQSSELLSEAKKLNDSQAPK

SEQ ID NO: 1530 - protein, 58 aa, ARTIFICIAL SEQUENCE
  Engineered IL-6 binding polypeptide
VDAKYAKEHRQAWMEIHLLPNLTIRQIAAFIAKLFDDPSQSSELLSEAKKLNDSQAPK

SEQ ID NO: 1531 - protein, 58 aa, ARTIFICIAL SEQUENCE
  Engineered IL-6 binding polypeptide
VDAKYAKEEKVAWHEIHVLPNLTVSQISAFITKLFDDPSQSSELLSEAKKLNDSQAPK

SEQ ID NO: 1532 - protein, 58 aa, ARTIFICIAL SEQUENCE
  Engineered IL-6 binding polypeptide
VDAKYAKEEKHAWYEIHLLPNLTISQLSAFIMKLFDDPSQSSELLSEAKKLNDSQAPK

SEQ ID NO: 1533 - protein, 58 aa, ARTIFICIAL SEQUENCE
  Engineered IL-6 binding polypeptide
VDAKYAKESAFAWWEIHLLPNLTVEQIAAFIWKLLDDPSQSSELLSEAKKLNDSQAPK

SEQ ID NO: 1534 - protein, 58 aa, ARTIFICIAL SEQUENCE
  Engineered IL-6 binding polypeptide
VDAKYAKEEQVAWREIHVLPNLTVEQVKAFINKLFDDPSQSSELLSEAKKLNDSQAPK

SEQ ID NO: 1535 - protein, 58 aa, ARTIFICIAL SEQUENCE
  Engineered IL-6 binding polypeptide
VDAKYAKEEMDAWTEIHILPNLTVEQMEAFIVKLFDDPSQSSELLSEAKKLNDSQAPK

SEQ ID NO: 1536 - protein, 58 aa, ARTIFICIAL SEQUENCE
  Engineered IL-6 binding polypeptide
VDAKYAKEEGRAWYEIHALPNLTVEQMSAFIIKLFDDPSQSSELLSEAKKLNDSQAPK

SEQ ID NO: 1537 - protein, 58 aa, ARTIFICIAL SEQUENCE
  Engineered IL-6 binding polypeptide
VDAKYAKEERNAWFEIHILPNLTLSQITAFIWKLLDDPSQSSELLSEAKKLNDSQAPK

SEQ ID NO: 1538 - protein, 58 aa, ARTIFICIAL SEQUENCE
  Engineered IL-6 binding polypeptide
VDAKYAKEEHNAWTEIHRLPNLTVKQTSAFIEKLFDDPSQSSELLSEAKKLNDSQAPK

SEQ ID NO: 1539 - protein, 58 aa, ARTIFICIAL SEQUENCE
  Engineered IL-6 binding polypeptide
VDAKYAKEEFKAWWEIHVLPNLTADQVAAFIVKLFDDPSQSSELLSEAKKLNDSQAPK

SEQ ID NO: 1540 - protein, 58 aa, ARTIFICIAL SEQUENCE
  Engineered IL-6 binding polypeptide
VDAKYAKEQHMAWTEIHLLPNLTVAQMAAFIVKLFDDPSQSSELLSEAKKLNDSQAPK

SEQ ID NO: 1541 - protein, 58 aa, ARTIFICIAL SEQUENCE
  Engineered IL-6 binding polypeptide
VDAKYAKEEQRAWWEIHLLPNLTARQTAAFIWKLMDDPSQSSELLSEAKKLNDSQAPK

SEQ ID NO: 1542 - protein, 58 aa, ARTIFICIAL SEQUENCE
  Engineered IL-6 binding polypeptide
VDAKYAKEQKSAWTEIHLLPNLTVHQISAFIAKLLDDPSQSSELLSEAKKLNDSQAPK

SEQ ID NO: 1543 - protein, 58 aa, ARTIFICIAL SEQUENCE
  Engineered IL-6 binding polypeptide
VDAKYAKEEHLAWKEIHKLPNLTVIQMAAFITKLFDDPSQSSELLSEAKKLNDSQAPK

SEQ ID NO: 1544 - protein, 58 aa, ARTIFICIAL SEQUENCE
  Engineered IL-6 binding polypeptide
VDAKYAKEERAAWWEIHMLPNLTADQMAAFIAKLFDDPSQSSELLSEAKKLNDSQAPK

SEQ ID NO: 1545 - protein, 58 aa, ARTIFICIAL SEQUENCE
  Engineered IL-6 binding polypeptide
VDAKYAKEQRTAWWEIHILPNLTVKQLVAFINKLFDDPSQSSELLSEAKKLNDSQAPK

SEQ ID NO: 1546 - protein, 58 aa, ARTIFICIAL SEQUENCE
  Engineered IL-6 binding polypeptide
VDAKYAKEEQIAWFEIHLLPNLTVGQRTAFIVKLFDDPSQSSELLSEAKKLNDSQAPK

SEQ ID NO: 1547 - protein, 58 aa, ARTIFICIAL SEQUENCE
  Engineered IL-6 binding polypeptide
VDAKYAKEERRAWFEISVLPNLTVDQTAAFIMKLFDDPSQSSELLSEAKKLNDSQAPK

SEQ ID NO: 1548 - protein, 58 aa, ARTIFICIAL SEQUENCE
  Engineered IL-6 binding polypeptide
VDAKYAKEEADAWMEIHILPNLTVLQRSAFIIKLFDDPSQSSELLSEAKKLNDSQAPK

SEQ ID NO: 1549 - protein, 58 aa, ARTIFICIAL SEQUENCE
  Engineered IL-6 binding polypeptide
VDAKYAKEEREAWFEIHVLPNLTIKQISAFIHKLFDDPSQSSELLSEAKKLNDSQAPK

SEQ ID NO: 1550 - protein, 58 aa, ARTIFICIAL SEQUENCE
  Engineered IL-6 binding polypeptide
VDAKYAKEERRAWFEIHTLPNLTVEQIEAFINKLFDDPSQSSELLSEAKKLNDSQAPK

SEQ ID NO: 1551 - protein, 58 aa, ARTIFICIAL SEQUENCE
  Engineered IL-6 binding polypeptide
VDAKYAKEERAAWWEIHGLPNLTVWQTAAFIVKLFDDPSQSSELLSEAKKLNDSQAPK

SEQ ID NO: 1552 - protein, 58 aa, ARTIFICIAL SEQUENCE
  Engineered Z variant
AEAKYAKELGWATWEIFNLPNLTGVQVKAFIDKLRDDPSQSSELLSEAKKLNDSQAPK

SEQ ID NO: 1553 - protein, 58 aa, ARTIFICIAL SEQUENCE
  Engineered Z variant
VDAKYAKELGWATWEIFNLPNLTGVQVKAFIDKLRDDPSQSSELLSEAKKLNDSQAPK

SEQ ID NO: 1554 - protein, 46 aa, ARTIFICIAL SEQUENCE
  Engineered albumin binding polypeptide
LAEAKEAANAELDSYGVSDFYKRLIDKAKTVEGVEALKDAILAALP

SEQ ID NO: 1555 - protein, 184 aa, HOMO SAPIENS
PVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 1556 - protein, 188 aa, MUS MUSCULUS
MFPTSQVRRGDFTEDTTPNRPVYTTSQVGGLITHVLWEIVEMRKELCNGNSDCMNNDDALAENNLKLPEIQRNDGCYQTGYNQEICLLKISSGLLEYHSYLEYMKNNLKDNKKDKARVLQRDTETLIHIFNQEVKDLHKIVLPTPISNALLTDKLESQKEWLRTKTIQFILKSLEEFLKVTLRSTRQT

SEQ ID NO: 1557 - protein, 451 aa, ARTIFICIAL SEQUENCE
  Heavy chain of antibody Ada
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1558 - protein, 214 aa, ARTIFICIAL SEQUENCE
  Light chain of antibody Ada
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1559 - protein, 451 aa, ARTIFICIAL SEQUENCE
  Heavy chain of antibody Ada2
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNVYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1560 - DNA, 24 bp, ARTIFICIAL SEQUENCE
  PCR primer
tgcttccggctcgtatgttgtgtg

SEQ ID NO: 1561 - DNA, 21 bp, ARTIFICIAL SEQUENCE
  PCR primer
cggaaccagagccaccaccgg

SEQ ID NO: 1562 - DNA, 21 bp, ARTIFICIAL SEQUENCE
  Sequencing primer
cggaaccagagccaccaccgg

SEQ ID NO: 1563 - DNA, 147 bp, ARTIFICIAL SEQUENCE
  Library oligonucleotide
  misc_feature (39)..(47): n is a, c, g, or t
  misc_feature (54)..(56): n is a, c, g, or t
  misc_feature (63)..(68): n is a, c, g, or t
  misc_feature (84)..(89): n is a, c, g, or t
  misc_feature (93)..(98): n is a, c, g, or t
  misc_feature (108)..(110): n is a, c, g, or t
  misc_feature (117)..(119): n is a, c, g, or t
aaataaatctcgaggtagatgccaaatacgccaaagaannnnnnnnngcgtggnnngagatcnnnnnnctgcctaacctcaccnnnnnncaannnnnngccttcatcnnnaaattannngatgacccaagccagagctcattattta

SEQ ID NO: 1564 - DNA, 147 bp, ARTIFICIAL SEQUENCE
  Library oligonucleotide
  misc_feature (39)..(47): n is a, c, g, or t
  misc_feature (51)..(56): n is a, c, g, or t
  misc_feature (63)..(68): n is a, c, g, or t
  misc_feature (84)..(89): n is a, c, g, or t
  misc_feature (93)..(98): n is a, c, g, or t
  misc_feature (108)..(110): n is a, c, g, or t
  misc_feature (117)..(119): n is a, c, g, or t
aaataaatctcgaggtagatgccaaatacgccaaagaannnnnnnnngctnnnnnngagatcnnnnnnctgccgaacctgaccnnnnnncagnnnnnngccttcatcnnnaaattannngatgacccaagccagagctcattattta

SEQ ID NO: 1565 - protein, 29 aa, Artificial Sequence
  Engineered IL6 binding polypeptide
  MISC_FEATURE (3)..(3): Xaa is selected from A, F, H, K, Q, R, S, W and Y
  MISC_FEATURE (4)..(4): Xaa is selected from A, D, E, F, H, I, K, L, M, N, Q, R, S, T, V and Y
  MISC_FEATURE (7)..(7): Xaa is selected from F, H, I, K, L, M, N, R, S, T, V, W and Y
  MISC_FEATURE (11)..(11): Xaa is selected from A, I, K, L, M, N, R, S, T and V
  MISC_FEATURE (16)..(16): Xaa is selected from N and T
  MISC_FEATURE (17)..(17): Xaa is selected from A, I, T and V
  MISC_FEATURE (18)..(18): Xaa is selected from D, E, G, H, K, N, Q, R, S and T
  MISC_FEATURE (20)..(20): Xaa is selected from I, L, M, R, T and V
  MISC_FEATURE (21)..(21): Xaa is selected from A, S, T and V
  MISC_FEATURE (25)..(25): Xaa is selected from I, M, Q, S, T, V and W
  MISC_FEATURE (26)..(26): Xaa is selected from K and S
  MISC_FEATURE (28)..(28): Xaa is selected from F, L, M and Y
  MISC_FEATURE (29)..(29): Xaa is selected from D and R
EEXXAWXEIHXLPNLXXXQXXAFIXXLXX

SEQ ID NO: 1566 - protein, 20 aa, Artificial Sequence
  Engineered IL6 binding polypeptide
  MISC_FEATURE (1)..(2): [BM] is an IL-6 binding motif with X29=D
  MISC_FEATURE (7)..(7): Xaa is selected from A and S
  MISC_FEATURE (8)..(8): Xaa is selected from N and E
  MISC_FEATURE (11)..(11): Xaa is selected from A, S and C
  MISC_FEATURE (17)..(17): Xaa is selected from E, N and S
  MISC_FEATURE (18)..(18): Xaa is selected from D, E and S
  MISC_FEATURE (19)..(19): Xaa is selected from A and S
KDPSQSXXLLXEAKKLXXXQ

SEQ ID NO: 1567 - protein, 20 aa, Artificial Sequence
  Engineered IL6 binding polypeptide
  MISC_FEATURE (1)..(2): [BM] is an IL-6 binding motif with X29=R
  MISC_FEATURE (7)..(7): Xaa is selected from A and S
  MISC_FEATURE (8)..(8): Xaa is selected from N and E
  MISC_FEATURE (11)..(11): Xaa is selected from A, S and C
  MISC_FEATURE (17)..(17): Xaa is selected from E, N and S
  MISC_FEATURE (18)..(18): Xaa is selected from D, E and S
  MISC_FEATURE (19)..(19): Xaa is selected from A and S
KQPEQSXXLLXEAKKLXXXQ

SEQ ID NO: 1568 - protein, 5 aa, Artificial Sequence
  Engineered IL6 binding polypeptide
  MISC_FEATURE (3)..(3): X=[BMod], which is an IL-6 binding module
YAXAP

SEQ ID NO: 1569 - protein, 5 aa, Artificial Sequence
  Engineered IL6 binding polypeptide
  MISC_FEATURE (3)..(3): X=[BMod], which is an IL-6 binding module
FNXAP

SEQ ID NO: 1570 - protein, 29 aa, Artificial Sequence
  Engineered IL6 binding polypeptide
  MISC_FEATURE (7)..(8): [BM] is an IL-6 binding motif
ADNNFNKDPSQSANLLSEAKKLNESQAPK

SEQ ID NO: 1571 - protein, 29 aa, Artificial Sequence
  Engineered IL6 binding polypeptide
  MISC_FEATURE (7)..(8): [BM] is an IL-6 binding motif
ADNKFNKDPSQSANLLAEAKKLNDAQAPK

SEQ ID NO: 1572 - protein, 29 aa, Artificial Sequence
  Engineered IL6 binding polypeptide
  MISC_FEATURE (7)..(8): [BM] is an IL-6 binding motif
ADNKFNKDPSVSKEILAEAKKLNDAQAPK

SEQ ID NO: 1573 - protein, 32 aa, Artificial Sequence
  Engineered IL6 binding polypeptide
  MISC_FEATURE (10)..(11): [BM] is an IL-6 binding motif
ADAQQNNFNKDPSQSTNVLGEAKKLNESQAPK

SEQ ID NO: 1574 - protein, 27 aa, Artificial Sequence
  Engineered IL6 binding polypeptide
  MISC_FEATURE (5)..(6): [BM] is an IL-6 binding motif
AQHDEDPSQSANVLGEAQKLNDSQAPK

SEQ ID NO: 1575 - protein, 29 aa, Artificial Sequence
  Engineered IL6 binding polypeptide
  MISC_FEATURE (7)..(8): [BM] is an IL-6 binding motif
VDNKFNKDPSQSANLLAEAKKLNDAQAPK

SEQ ID NO: 1576 - protein, 29 aa, Artificial Sequence
  Engineered IL6 binding polypeptide
  MISC_FEATURE (7)..(8): [BM] is an IL-6 binding motif
AEAKYAKDPSESSELLSEAKKLNKSQAPK

SEQ ID NO: 1577 - protein, 29 aa, Artificial Sequence
  Engineered IL6 binding polypeptide
  MISC_FEATURE (7)..(8): [BM] is an IL-6 binding motif
VDAKYAKDPSQSSELLAEAKKLNDAQAPK

SEQ ID NO: 1578 - protein, 29 aa, Artificial Sequence
  Engineered IL6 binding polypeptide
  MISC_FEATIURE (7)..(8): [BM] is an IL-6 binding motif
VDAKYAKDPSQSSELLAEAKKLNDSQAPK

SEQ ID NO: 1579 - protein, 29 aa, Artificial Sequence
  Engineered IL6 binding polypeptide
  MISC_FEATURE (7)..(8): [BM] is an IL-6 binding motif
AEAKYAKDPSQSSELLSEAKKLNDSQAPK

SEQ ID NO: 1580 - protein, 29 aa, Artificial Sequence
  Engineered IL6 binding polypeptide
  MISC_FEATURE (7)..(8): [BM] is an IL-6 binding motif
AEAKYAKDPSQSSELLSEAKKLSESQAPK

SEQ ID NO: 1581 - protein, 29 aa, Artificial Sequence
  Engineered IL6 binding polypeptide
  MISC_FEATURE (7)..(8): [BM] is an IL-6 binding motif
AEAKYAKQPEQSSELLSEAKKLSESQAPK

SEQ ID NO: 1582 - protein, 29 aa, Artificial Sequence
  Engineered IL6 binding polypeptide
  MISC_FEATURE (7)..(8): [BM] is an IL-6 binding motif
AEAKYAKDPSQSSELLSEAKKLESSQAPK

SEQ ID NO: 1583 - protein, 29 aa, Artificial Sequence
  Engineered IL6 binding polypeptide
  MISC_FEATURE (7)..(8): [BM] is an IL-6 binding motif
AEAKYAKQPEQSSELLSEAKKLESSQAPK

SEQ ID NO: 1584 - protein, 29 aa, Artificial Sequence
  Engineered IL6 binding polypeptide
  MISC_FEATURE (7)..(8): [BM] is an IL-6 binding motif
VDAKYAKDPSQSSELLSEAKKLNDSQAPK

SEQ ID NO: 1585 - protein, 29 aa, Artificial Sequence
  Engineered IL6 binding polypeptide
  MISC_FEATURE (7)..(8): [BM] is an IL-6 binding motif
VDAKYAKDPSQSSELLSEAKKLSESQAPK

SEQ ID NO: 1586 - protein, 29 aa, Artificial Sequence
  Engineered IL6 binding polypeptide
  MISC_FEATURE (7)..(8): [BM] is an IL-6 binding motif
VDAKYAKQPEQSSELLSEAKKLSESQAPK

SEQ ID NO: 1587 - protein, 29 aa, Artificial Sequence
  Engineered IL6 binding polypeptide
  MISC_FEATURE (7)..(8): [BM] is an IL-6 binding motif
VDAKYAKDPSQSSELLSEAKKLESSQAPK

SEQ ID NO: 1588 - protein, 29 aa, Artificial Sequence
  Engineered IL6 binding polypeptide
  MISC_FEATURE (7)..(8): [BM] is an IL-6 binding motif
VDAKYAKQPEQSSELLSEAKKLESSQAPK

SEQ ID NO: 1589 - protein, 29 aa, Artificial Sequence
  Engineered IL6 binding polypeptide
  MISC_FEATURE (7)..(8): [BM] is an IL-6 binding motif
VDAKYAKDPSQSSELLAEAKKLNKAQAPK

SEQ ID NO: 1590 - protein, 29 aa, Artificial Sequence
  Engineered IL6 binding polypeptide
  MISC_FEATURE (7)..(8): [BM] is an IL-6 binding motif
AEAKYAKDPSQSSELLAEAKKLNKAQAPK

SEQ ID NO: 1591 - protein, 5 aa, Artificial Sequence
  Artificial Linker
GGGGS

SEQ ID NO: 1592 - protein, 18 aa, Artificial Sequence
  Artificial Linker
KESGSVSSEQLAQFRSLD

SEQ ID NO: 1593 - protein, 13 aa, Artificial Sequence
  Artificial Linker
EGKSSGSGSEKST

SEQ ID NO: 1594 - protein, 12 aa, Artificial Sequence
  Artificial Linker
GSAGSAAGSGEF

SEQ ID NO: 1595 - protein, 15 aa, Artificial Sequence
  Artificial Linker
GGGGSGGGGSGGGGS

SEQ ID NO: 1596 - protein, 4 aa, Artificial Sequence
  Artificial Linker
VDGS

SEQ ID NO: 1597 - protein, 4 aa, Artificial Sequence
  Artificial Linker
ASGS

SEQ ID NO: 1598 - protein, 14 aa, Artificial Sequence
  Engineered IL6 binding polypeptide
  MISC_FEATURE (12)..(13): Z Variant
MGSSHHHHHHLQVD

SEQ ID NO: 1599 - protein, 11 aa, artificial sequence
  Engineered IL6 binding polypeptide
  MISC_FEATURE (7)..(7): X=Z variant
MGSSLQXVDGS

SEQ ID NO: 1600 - protein, 16 aa, Artificial Sequence
  Engineered polypeptide
  MISC_FEATURE (8)..(9): Z variant sequence
  MISC_FEATURE (12)..(13): Albumin binding domain
AQHDEALEVDYVYVPG

SEQ ID NO: 1601 - protein, 6 aa, Artificial Sequence
  (HIS-GLU)3 Tag
HEHEHE

---

The invention claimed is:

1. A complex comprising at least one interleukin-6 (IL-6) binding polypeptide and at least one antibody or an antigen binding fragment thereof, wherein said IL-6 binding polypeptide comprises an IL-6 binding motif BM, which motif consists of the amino acid sequence selected from:

i) $EEX_3X_4AWX_7EIHX_{11}LPNLX_{16}X_{17}X_{18}QX_{20}X_{21}AFIX_{25}X_{26}LX_{28}X_{29}$ (SEQ ID NO:1565) wherein, independently from each other, $X_3$ is selected from A, F, H, K, Q, R, S, W and Y;
$X_4$ is selected from A, D, E, F, H, I, K, L, M, N, Q, R, S, T, V and Y;
$X_7$ is selected from F, H, I, K, L, M, N, R, S, T, V, W and Y;
$X_{11}$ is selected from A, I, K, L, M, N, R, S, T and V;
$X_{16}$ is selected from N and T;
$X_{17}$ is selected from A, I, T and V;
$X_{18}$ is selected from D, E, G, H, K, N, Q, R, S and T;
$X_{20}$ is selected from I, L, M, R, T and V;
$X_{21}$ is selected from A, S, T and V;
$X_{25}$ is selected from I, M, Q, S, T, V and W;
$X_{26}$ is selected from K and S;
$X_{28}$ is selected from F, L, M and Y; and
$X_{29}$ is selected from D and R;
and ii) an amino acid sequence which has at least 93% identity to the sequence defined in i).

2. The complex according to claim 1, wherein sequence i) is the sequence from position 8 to position 36 in a sequence selected from the group consisting of SEQ ID NO:1-1551.

3. The complex according to claim 1, wherein said IL-6 binding motif forms part of a three-helix bundle protein domain.

4. The complex according to claim 1, wherein said IL-6 binding polypeptide comprises a binding module BMod, the amino acid sequence of which is selected from:

iii)
K-[BM]-DPSQSX$_a$X$_b$LLX$_c$EAKKLX$_d$X$_e$X$_f$Q; (SEQ ID NO: 1566)

wherein
[BM] is the IL-6 binding motif according to claim 1, provided that $X_{29}$ is D;
$X_a$ is selected from A and S;
$X_b$ is selected from N and E;
$X_c$ is selected from A, S and C;
$X_d$ is selected from E, N and S;
$X_e$ is selected from D, E and S;
$X_f$ is selected from A and S.

5. The complex according to claim 1, which comprises the amino acid sequence selected from:

xi)
VDAKYAK-[BM]-DPSQSSELLSEAKKLNDSQAPK;
(SEQ ID NO: 1584)

wherein [BM] is the IL-6 binding motif according to claim 1.

6. The complex according to claim 5, wherein sequence xi) is selected from the group consisting of SEQ ID NO:1-1551.

7. The complex according to claim 1, wherein said antibody or antigen binding fragment thereof has affinity for an additional antigen.

8. The complex according to claim 7, wherein said antibody or antigen binding fragment thereof is selected from the group consisting of adalimumab, infliximab, golimumab and certolizumab pegol and antigen binding fragments thereof.

9. The complex according to claim 1, which is capable of blocking IL-6 dependent signaling via the cis-signaling pathway and/or the trans-signaling pathway.

10. The complex according to claim 9, wherein the half maximal inhibitory concentration of blocking IL-6 signaling is at most $1\times10^{-6}$ M.

11. The complex according to claim 1, which is capable of binding to IL-6 such that the EC50 value of the interaction is at most $1\times10^{-7}$ M, or such that the $K_D$ value of the interaction is at most $1\times10^{-8}$ M.

12. The complex according to claim 7, which is capable of blocking TNF dependent signaling.

13. The complex according to claim 12, wherein the half maximal inhibitory concentration of blocking TNF dependent signaling is at most $1\times10^{-7}$ M.

14. The complex according to claim 7, which is capable of binding to TNF such that the $K_D$ value of the interaction is at most $1\times10^{-7}$ M.

15. The complex according to claim 1, which is a fusion protein.

16. The complex according to claim 15, further comprising at least one linker.

17. The complex according to claim 16, wherein said linker has a general formula selected from $(G_nS_m)_p$ and $(S_mG_n)_p$, wherein, independently,
n=1-7,
m=0-7,
n+m≤8 and
p=1-7.

18. A polynucleotide encoding a polypeptide encoding a fusion protein according to claim 15.

19. A composition comprising the complex according to claim 1 and at least one pharmaceutically acceptable excipient or carrier.

20. A method of treating an IL-6 related disorder comprising,
administering to a subject having an IL-6 related disorder an amount of the complex according to claim 1 effective to block IL-6 signaling at least partially,
wherein said disorder is rheumatoid arthritis; juvenile rheumatoid arthritis; juvenile idiopathic arthritis; systemic juvenile idiopathic arthritis; vasculitis; psoriatic arthritis; psoriasis; chronic inflammatory bowel disease; Crohn's disease; ulcerative colitis; Grave's disease; Behçet's disease; uveitis; giant cell arteritis; multiple sclerosis; systemic sclerosis; systemic lupus erythematosus; polymyositis; polymyalgia rheumatic; relapsing polychondritis; pancreatitis; peritonitis; nephritis; Sjögren's syndrome; adult Still's disease; or Castleman's disease.

21. The complex according to claim 2, wherein sequence i) is the sequence from position 8 to position 36 in a sequence selected from the group consisting of SEQ ID NO:1-14 and SEQ ID NO:1512.

22. The complex according to claim 21, wherein sequence i) is the sequence from position 8 to position 36 in SEQ ID NO:1512.

23. The method according to claim 20, wherein the blocking is of the cis- and/or the trans-signaling pathway.

24. The method according to claim 20, wherein the blocking is of interaction of IL-6/IL-6Rα with gp130.

\* \* \* \* \*